United States Patent
Hatzfeld et al.

(10) Patent No.: US 9,388,423 B2
(45) Date of Patent: Jul. 12, 2016

(54) PLANTS HAVING ENHANCED YIELD-RELATED TRAITS AND A METHOD FOR MAKING THE SAME

(75) Inventors: Yves Hatzfeld, Lille (FR); Dirk Inzé, Moorsel-Aalst (BE); Geert De Jaeger, Evergem (BE); Aurine Verkest, Ghent (BE); Valerie Frankard, Waterloo (BE); Christophe Reuzeau, La Chapelle Gonaguet (FR); Ana Isabel Sanz Molinero, Madrid (ES); Koen Bruynseels, Wichelen (BE)

(73) Assignee: BASF Plant Science Company GmbH, Ludwigshafen (DE)

( * ) Notice: Subject to any disclaimer, the term of this patent is extended or adjusted under 35 U.S.C. 154(b) by 778 days.

(21) Appl. No.: 13/580,848

(22) PCT Filed: Feb. 10, 2011

(86) PCT No.: PCT/EP2011/052000
§ 371 (c)(1),
(2), (4) Date: Aug. 23, 2012

(87) PCT Pub. No.: WO2011/104128
PCT Pub. Date: Sep. 1, 2011

(65) Prior Publication Data
US 2012/0331586 A1    Dec. 27, 2012

Related U.S. Application Data

(60) Provisional application No. 61/307,502, filed on Feb. 24, 2010, provisional application No. 61/307,875, filed on Feb. 25, 2010.

(30) Foreign Application Priority Data

Feb. 24, 2010   (EP) ..................................... 10154550
Feb. 25, 2010   (EP) ..................................... 10154693

(51) Int. Cl.
*C12N 15/82*    (2006.01)
(52) U.S. Cl.
CPC ................................. *C12N 15/8261* (2013.01)
(58) Field of Classification Search
None
See application file for complete search history.

(56) References Cited

U.S. PATENT DOCUMENTS

2004/0031072 A1    2/2004   La Rosa et al.
2004/0216190 A1   10/2004   Kovalic
2009/0019601 A1*   1/2009   Kovalic .......................... 800/279

FOREIGN PATENT DOCUMENTS

WO    WO-2008/074891 A2    6/2008
WO    WO 2010023320 A2 *   3/2010

OTHER PUBLICATIONS

UniprotKB Q9FKT0 (2007).*
Coates (Armadillo repeat proteins: beyond the animal kingdom, 13 Trends in Cell Biology, 463-471 (2003)).*
Hill et al (Functional analysis of conserved histidines in ADP-glucose pyrophosphorylase from *Escherichia coli*. Biochem. Biophys. Res. Comm. 244:573-577, 1998).*
Guo et al (Protein tolerance to random amino acid change, Proc. Natl. Acad. Sci. USA 101:9205-9210, 2004).*
Fourgoux-Nicol et al (1999, Plant Molecular Biology 40: 857-872).*
Friedberg (Automated protein function prediction—the genomic challenge. Brief. Bioinformatics. 7:225-242, 2006).*
International Search Report for PCT/EP2011/052000, mailed Sep. 5, 2011.
"Populus trichocarpa Predicted Protein, mRNA", Database GenBank Accession No. XM_002314665, Feb. 25, 2009.
International Preliminary Report on Patentability for PCT/EP2011/052000 Dated Aug. 28, 2012.

* cited by examiner

*Primary Examiner* — Medina A Ibrahim
*Assistant Examiner* — Wayne Zhong
(74) *Attorney, Agent, or Firm* — Drinker Biddle & Reath LLP

(57) ABSTRACT

The present invention relates generally to the field of molecular biology and concerns a method for enhancing yield-related traits in plants by modulating expression in a plant of a nucleic acid encoding an importin or a yield-related polypeptide. The present invention also concerns plants having modulated expression of a nucleic acid encoding an importin or a yield-related polypeptide, which plants have enhanced yield-related traits relative to corresponding wild type plants or other control plants. The invention also provides constructs useful in the methods of the invention.

23 Claims, 2 Drawing Sheets

PLANTS HAVING ENHANCED YIELD-RELATED TRAITS AND A METHOD FOR MAKING THE SAME

RELATED APPLICATIONS

This application is a national stage application (under 35 U.S.C. §371) of PCT/EP2011/052000, filed Feb. 10, 2011, which claims benefit of European Patent Application No. 10154550.7, filed Feb. 24, 2010, U.S. Provisional Application 61/307,502, filed Feb. 24, 2010, European Patent Application No. 10154693.5, filed Feb. 25, 2010, and U.S. Provisional Application No. 61/307,875, filed Feb. 25, 2010.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing_32279_00051_US. The size of the text file is 815 KB and the text file was created on Aug. 21, 2012.

The present invention relates generally to the field of molecular biology and concerns a method for enhancing yield-related traits in plants by modulating expression in a plant of a nucleic acid encoding an importin or a yield-related polypeptide. The present invention also concerns plants having modulated expression of a nucleic acid encoding an importin or a yield-related polypeptide, which plants have enhanced yield-related traits relative to corresponding wild type plants or other control plants. The invention also provides constructs useful in the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (Zea mays L.) hybrids based on Corn Belt germplasm in the European Atlantic.

A further important trait is that of improved abiotic stress tolerance. Abiotic stress is a primary cause of crop loss worldwide, reducing average yields for most major crop plants by more than 50% (Wang et al., Planta 218, 1-14, 2003). Abiotic stresses may be caused by drought, salinity, extremes of temperature, chemical toxicity and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield (seed yield and/or biomass) in plants may be through modification of the inherent growth mechanisms of a plant, such as the cell cycle or various signalling pathways involved in plant growth or in defence mechanisms.

It has now been found that various yield-related traits may be improved in plants by modulating expression in a plant of a nucleic acid encoding an importin or a yield-related polypeptide in a plant as defined herein.

SUMMARY

Surprisingly, it has now been found that modulating expression of a nucleic acid encoding an importin or a yield-related polypeptide as defined herein gives plants having enhanced yield-related traits, in particular increased yield, more preferably increased seed yield relative to control plants.

According one embodiment, there is provided a method for improving yield-related traits in plants relative to control plants, comprising modulating expression in a plant of a nucleic acid encoding an importin or a yield-related polypeptide.

DEFINITIONS

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide and may range from 1 to 10 amino acids; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |

TABLE 1-continued

Examples of conserved amino acid substitutions

| Residue | Conservative Substitutions |
|---|---|
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain, Motif/Consensus Sequence/Signature

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

Reciprocal BLAST

Typically, this involves a first BLAST involving BLASTing a query sequence (for example using any of the sequences listed in Table A of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived. The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m = 81.5°\text{C.} + 16.6 \times \log_{10}[Na^+]^a + 0.41 \times \%[G/C^b] - 500 \times [L^c]^{-1} - 0.61 \times \% \text{ formamide}$$

2) DNA-RNA or RNA-RNA hybrids:

$$Tm = 79.8 + 18.5(\log_{10}[Na^+]^a) + 0.58(\% G/C^b) + 11.8(\% G/C^b)^2 - 820/L^c$$

3) oligo-DNA or oligo-RNA$^d$ hybrids:

For <20 nucleotides: $T_m = 2(I_n)$

For 20-35 nucleotides: $T_m = 22 + 1.46(I_n)$ $^a$ or for other monovalent cation, but only accurate in the 0.01-0.4 M range.
$^b$ only accurate for % GC in the 30% to 75% range.
$^c$ L=length of duplex in base pairs.
$^d$ oligo, oligonucleotide; $I_n$,=effective length of primer=2× (no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3rd Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Construct

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RTPCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500,0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
|---|---|
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J November; 2(6): 837-44, 1992, WO 2004/065596 |

TABLE 2a-continued

Examples of constitutive promoters

| Gene Source | Reference |
| --- | --- |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
| --- | --- |
| RCc3 | Plant Mol Biol. 1995 January; 27(2): 237-48 |
| Arabidopsis PHT1 | Kovama et al., 2005; Mudge et al. (2002, Plant J. 31: 341) |
| Medicago phosphate transporter | Xiao et al., 2006 |
| Arabidopsis Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| B. napus G1-3b gene | U.S. Pat. No. 5,401,836 |
| SbPRP1 | Suzuki et al., Plant Mol. Biol. 21: 109-119, 1993. |
| LRX1 | Baumberger et al. 2001, Genes & Dev. 15: 1128 |
| BTG-26 Brassica napus | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 153: 386-395, 1991. |
| KDC1 (Daucus carota) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (Arabidopsis) | Diener et al. (2001, Plant Cell 13: 1625) |
| NRT2; 1Np (N. plumbaginifolia) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters (endosperm/aleurone/embryo specific) are shown in Table 2c to Table 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
| --- | --- |
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley Itr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |

TABLE 2c-continued

Examples of seed-specific promoters

| Gene source | Reference |
|---|---|
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| sorghum α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2d examples of endosperm-specific promoters

| Gene source | Reference |
|---|---|
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al, (1998) Plant J 116(1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39(8) 885-889 |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| sorghum kafirin | DeRose et al. (1996) Plant Mol Biol 32: 1029-35 |

TABLE 2e

Examples of embryo specific promoters:

| Gene source | Reference |
|---|---|
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2f

Examples of aleurone-specific promoters:

| Gene source | Reference |
|---|---|
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2g below.

TABLE 2g

Examples of green tissue-specific promoters

| Gene | Expression | Reference |
| --- | --- | --- |
| Maize Orthophosphate dikinase | Leaf specific | Fukayama et al., 2001 |
| Maize Phosphoenolpyruvate carboxylase | Leaf specific | Kausch et al., 2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2h below.

TABLE 2h

Examples of meristem-specific promoters

| Gene source | Expression pattern | Reference |
| --- | --- | --- |
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to micro-organisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either
- (a) the nucleic acid sequences encoding proteins useful in the methods of the invention, or
- (b) genetic control sequence(s) which is operably linked with the nucleic acid sequence according to the invention, for example a promoter, or
- (c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an α-anomeric nucleic acid sequence. An α-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anti-cancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. MiRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefadiens*, for example pBin19 (Bevan et al., Nucl. Acids Res. 12 (1984) 8711). *Agrobacteria* transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic [Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

TILLING

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss Physcomitrella. Methods for performing homologous recombination in plants have been described not only for model plants (Offringa a et al. (1990) EMBO J 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield Related Traits

Yield related traits comprise one or more of yield, biomass, seed yield, early vigour, greenness index, increased growth rate, improved agronomic traits (such as improved Water Use Efficiency (WUE), Nitrogen Use Efficiency (NUE), etc.).

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant may relate to vegetative biomass (root and/or shoot biomass), to reproductive organs, and/or to propagules (such as seeds) of that plant.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter, number of panicles per plant, panicle length, number of spikelets per panicle, number of flowers (florets) per panicle, increase in the seed filling rate (which is the number of filled seeds divided by the total number of seeds and multiplied by 100), increase in thousand kernel weight, among others. In rice, submergence tolerance may also result in increased yield.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increased Growth Rate

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as speed of germination, early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

Stress Resistance

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35%, 30% or 25%, more preferably less than 20% or 15% in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield in increasing order of preference at least 97%, 95%, 92%, 90%, 87%, 85%, 83%, 80%, 77% or 75% of the average production of such plant in a given environment. Average production may be calculated on harvest and/or season basis. Persons skilled in the art are aware of average yield productions of a crop.

Nutrient deficiency may result from a lack of nutrients such as nitrogen, phosphates and other phosphorous-containing compounds, potassium, calcium, magnesium, manganese, iron and boron, amongst others.

The term salt stress is not restricted to common salt (NaCl), but may be any one or more of: NaCl, KCl, LiCl, $MgCl_2$, $CaCl_2$, amongst others.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per square meter; b) increased number of flowers per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; and f) increased thousand kernel weight (TKW), which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased yield may also result in modified architecture, or may occur because of modified architecture.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Marker Assisted Breeding

Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Use as Probes in (Gene Mapping)

Use of nucleic acids encoding the protein of interest for genetically and physically mapping the genes requires only a nucleic acid sequence of at least 15 nucleotides in length. These nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acids encoding the protein of interest. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid encoding the protein of interest in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elata*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Eragrostis tef*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp., *Pinus* spp., *Pistacia vera*, *Pisum* spp., *Poa* spp., *Populus* spp., *Prosopis* spp., *Prunus* spp., *Psidium* spp., *Punica granatum*, *Pyrus communis*, *Quercus* spp., *Raphanus sativus*, *Rheum rhabarbarum*, *Ribes* spp., *Ricinus communis*, *Rubus* spp., *Saccharum* spp., *Salix* sp., *Sambucus* spp., *Secale cereale*, *Sesamum* spp., *Sinapis* sp., *Solanum* spp. (e.g. *Solanum tuberosum*, *Solanum integrifolium* or *Solanum lycopersicum*), *Sorghum bicolor*, *Spinacia* spp., *Syzygium* spp., *Tagetes* spp., *Tamarindus indica*, *Theobroma cacao*, *Trifolium* spp., *Tripsacum dactyloides*, *Triticosecale rimpaui*, *Triticum* spp. (e.g. *Triticum aestivum*, *Triticum durum*, *Triticum turgidum*, *Triticum hybernum*, *Triticum macha*, *Triticum sativum*, *Triticum monococcum* or *Triticum vulgare*), *Tropaeolum minus*, *Tropaeolum majus*, *Vaccinium* spp., *Vicia* spp., *Vigna* spp., *Viola odorata*, *Vitis* spp., *Zea mays*, *Zizania palustris*, *Ziziphus* spp., amongst others.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

DETAILED DESCRIPTION OF THE INVENTION

Surprisingly, it has now been found that modulating expression in a plant of a nucleic acid encoding an importin or a yield-related polypeptide as defined herein gives plants having enhanced yield-related traits relative to control plants. According to a first embodiment, the present invention provides a method for enhancing yield-related traits in plants relative to control plants, comprising modulating expression in a plant of a nucleic acid encoding an importin or a yield-related polypeptide and optionally selecting for plants having enhanced yield-related traits.

A preferred method for modulating (preferably, increasing) expression of a nucleic acid encoding an importin or a yield-related polypeptide is by introducing and expressing in a plant a nucleic acid encoding an importin or a yield-related polypeptide.

In one embodiment a reference hereinafter to a "protein useful in the methods of the invention" is taken to mean an importin polypeptide as defined herein. In such embodiment, a reference hereinafter to a "nucleic acid useful in the methods of the invention" is taken to mean a nucleic acid capable of encoding such an importin polypeptide. The nucleic acid to be introduced into a plant (and therefore useful in performing the methods of the invention) is any nucleic acid encoding the type of protein which will now be described, hereafter also named "an importin nucleic acid" or "importin gene".

In another embodiment, a reference hereinafter to a "protein useful in the methods of the invention" is taken to mean a yield-related polypeptide as defined herein. In such embodiment, a reference hereinafter to a "nucleic acid useful in the methods of the invention" is taken to mean a nucleic acid capable of encoding such a yield-related polypeptide. The nucleic acid to be introduced into a plant (and therefore useful in performing the methods of the invention) is any nucleic acid encoding the type of protein which will now be described, hereafter also named "a yield-related nucleic acid" or "yield-related gene".

An "importin polypeptide" as defined herein refers to one or more of the following:
  (i) a polypeptide represented by SEQ ID NO: 2 or SEQ ID NO: 4 or a homologue thereof;
  (ii) a nucleic acid encoding a polypeptide represented by any one of SEQ ID NO: 2 or SEQ ID NO: 4;
  (iii) a nucleic acid represented by any one of SEQ ID NO: 1 or SEQ ID NO: 3 or a portion thereof or a sequence capable of hybridising thereto;
  (iv) a polypeptide sequence having a domain represented by one of the InterPro accession numbers described in Table 3a or Table 4a below.

A "yield related polypeptide" as defined herein refers to one or more of the following:
(i) a polypeptide represented by SEQ ID NO: 125, SEQ ID NO: 127, SEQ ID NO: 129, SEQ ID NO: 131, SEQ ID NO: 133 or SEQ ID NO: 135 or a homologue thereof;
(ii) a nucleic acid encoding a polypeptide represented by any one of SEQ ID NO: 125, SEQ ID NO: 127, SEQ ID NO: 129, SEQ ID NO: 131, SEQ ID NO: 133 or SEQ ID NO: 135;
(iii) a nucleic acid represented by any one of SEQ ID NO: 124, SEQ ID NO: 126, SEQ ID NO: 128, SEQ ID NO: 130, SEQ ID NO: 132 or SEQ ID NO: 134 or a portion thereof or a sequence capable of hybridising thereto;
(iv) a polypeptide sequence having a domain represented by one of the InterPro accession numbers described in Table 3b, 4b, 5, 6, 7 or 8 below.

TABLE 3a

Homologues of SEQ ID NO: 2 and corresponding InterPro scan results (major accession numbers)

| Accession number of homologue | Database | Domain accession | Domain name | InterPro accession | amino acid start coordinate | amino acid end coordinate | SEQ ID NO | SEQ ID NO |
|---|---|---|---|---|---|---|---|---|
| AT1G09270.1 | HMMPanther | PTHR23316 | PTHR23316 | NULL | 1 | 537 | 5 | 6 |
| AT1G09270.1 | HMMPanther | PTHR23316 | PTHR23316 | NULL | 1 | 537 | 5 | 6 |
| AT1G09270.1 | superfamily | SSF48371 | ARM-type_fold | IPR016024 | 49 | 501 | 5 | 6 |
| AT1G09270.1 | Gene3D | G3DSA:1.25.10.10ARM-like | | IPR011989 | 81 | 501 | 5 | 6 |
| AT1G09270.1 | ProfileScan | PS51214 | IBB | IPR002652 | 1 | 58 | 5 | 6 |
| AT1G09270.1 | HMMPfam | PF01749 | IBB | IPR002652 | 4 | 102 | 5 | 6 |
| AT1G09270.1 | Gene3D | G3DSA:1.20.5.690Importin-a-like_IBB-bd | | IPR002652 | 9 | 52 | 5 | 6 |
| AT1G09270.1 | ProfileScan | PS50176 | ARM_REPEAT | IPR000225 | 333 | 376 | 5 | 6 |
| AT1G09270.1 | ProfileScan | PS50176 | ARM_REPEAT | IPR000225 | 165 | 207 | 5 | 6 |
| AT1G09270.1 | ProfileScan | PS50176 | ARM_REPEAT | IPR000225 | 122 | 165 | 5 | 6 |
| AT1G09270.1 | HMMSmart | SM00185 | ARM | IPR000225 | 408 | 448 | 5 | 6 |
| AT1G09270.1 | HMMSmart | SM00185 | ARM | IPR000225 | 365 | 405 | 5 | 6 |
| AT1G09270.1 | HMMSmart | SM00185 | ARM | IPR000225 | 322 | 363 | 5 | 6 |
| AT1G09270.1 | HMMSmart | SM00185 | ARM | IPR000225 | 280 | 320 | 5 | 6 |
| AT1G09270.1 | HMMSmart | SM00185 | ARM | IPR000225 | 239 | 278 | 5 | 6 |
| AT1G09270.1 | HMMSmart | SM00185 | ARM | IPR000225 | 195 | 237 | 5 | 6 |
| AT1G09270.1 | HMMSmart | SM00185 | ARM | IPR000225 | 154 | 194 | 5 | 6 |
| AT1G09270.1 | HMMSmart | SM00185 | ARM | IPR000225 | 111 | 152 | 5 | 6 |
| AT1G09270.1 | HMMPfam | PF00514 | Arm | IPR000225 | 408 | 448 | 5 | 6 |
| AT1G09270.1 | HMMPfam | PF00514 | Arm | IPR000225 | 365 | 405 | 5 | 6 |
| AT1G09270.1 | HMMPfam | PF00514 | Arm | IPR000225 | 322 | 363 | 5 | 6 |
| AT1G09270.1 | HMMPfam | PF00514 | Arm | IPR000225 | 280 | 320 | 5 | 6 |
| AT1G09270.1 | HMMPfam | PF00514 | Arm | IPR000225 | 239 | 278 | 5 | 6 |
| AT1G09270.1 | HMMPfam | PF00514 | Arm | IPR000225 | 196 | 237 | 5 | 6 |
| AT1G09270.1 | HMMPfam | PF00514 | Arm | IPR000225 | 154 | 194 | 5 | 6 |
| AT1G09270.1 | HMMPfam | PF00514 | Arm | IPR000225 | 111 | 152 | 5 | 6 |

Homologues of SEQ ID NO: 5 and SEQ ID NO: 6

| Name homologue | Nucleic acid SEQ ID NO: | Polypeptide SEQ ID NO: |
|---|---|---|
| >B.napus_TC77714#1 | 21 | 22 |
| >G.max_Glyma09g04430.1#1 | 23 | 24 |
| >G.hirsutum_ES800234#1 | 25 | 26 |
| >H.vulgare_TC178368#1 | 27 | 28 |
| >M.truncatula_AC191599_15.4#1 | 29 | 30 |
| >O.sativa_Os05g0155500#1 | 31 | 32 |
| >P.patens_TC29288#1 | 33 | 34 |
| >P.trichocarpa_scaff_XIII.64#1 | 35 | 36 |
| >S.lycopersicum_TC192018#1 | 37 | 38 |
| >T.aestivum_TC326489#1 | 39 | 40 |
| >Z.mays_ZM07MC09815_62040840@9797#1 | 41 | 42 |

| Accession number of homologue | Database | Domain accession | Domain name | InterPro accession | amino acid start coordinate | amino acid end coordinate | SEQ ID NO | SEQ ID NO |
|---|---|---|---|---|---|---|---|---|
| AT3G06720.1 | HMMPanther | PTHR23316 | PTHR23316 | NULL | 1 | 531 | 7 | 8 |
| AT3G06720.1 | HMMPanther | PTHR23316 | PTHR23316 | NULL | 1 | 531 | 7 | 8 |
| AT3G06720.1 | superfamily | SSF48371 | ARM-type_fold | IPR016024 | 43 | 494 | 7 | 8 |
| AT3G06720.1 | Gene3D | G3DSA:1.25.10.10ARM-like | | IPR011989 | 72 | 494 | 7 | 8 |
| AT3G06720.1 | ProfileScan | PS51214 | IBB | IPR002652 | 1 | 58 | 7 | 8 |
| AT3G06720.1 | HMMPfam | PF01749 | IBB | IPR002652 | 4 | 95 | 7 | 8 |
| AT3G06720.1 | ProfileScan | PS50176 | ARM_REPEAT | IPR000225 | 326 | 361 | 7 | 8 |
| AT3G06720.1 | ProfileScan | PS50176 | ARM_REPEAT | IPR000225 | 242 | 284 | 7 | 8 |
| AT3G06720.1 | ProfileScan | PS50176 | ARM_REPEAT | IPR000225 | 158 | 186 | 7 | 8 |
| AT3G06720.1 | ProfileScan | PS50176 | ARM_REPEAT | IPR000225 | 115 | 154 | 7 | 8 |
| AT3G06720.1 | HMMSmart | SM00185 | ARM | IPR000225 | 401 | 441 | 7 | 8 |
| AT3G06720.1 | HMMSmart | SM00185 | ARM | IPR000225 | 358 | 398 | 7 | 8 |
| AT3G06720.1 | HMMSmart | SM00185 | ARM | IPR000225 | 315 | 356 | 7 | 8 |

TABLE 3a-continued

| | | | | | | | | |
|---|---|---|---|---|---|---|---|---|
| AT3G06720.1 | HMMSmart | SM00185 | ARM | IPR000225 | 273 | 313 | 7 | 8 |
| AT3G06720.1 | HMMSmart | SM00185 | ARM | IPR000225 | 232 | 271 | 7 | 8 |
| AT3G06720.1 | HMMSmart | SM00185 | ARM | IPR000225 | 188 | 230 | 7 | 8 |
| AT3G06720.1 | HMMSmart | SM00185 | ARM | IPR000225 | 147 | 187 | 7 | 8 |
| AT3G06720.1 | HMMSmart | SM00185 | ARM | IPR000225 | 104 | 145 | 7 | 8 |
| AT3G06720.1 | HMMPfam | PF00514 | Arm | IPR000225 | 401 | 441 | 7 | 8 |
| AT3G06720.1 | HMMPfam | PF00514 | Arm | IPR000225 | 358 | 398 | 7 | 8 |
| AT3G06720.1 | HMMPfam | PF00514 | Arm | IPR000225 | 315 | 356 | 7 | 8 |
| AT3G06720.1 | HMMPfam | PF00514 | Arm | IPR000225 | 273 | 313 | 7 | 8 |
| AT3G06720.1 | HMMPfam | PF00514 | Arm | IPR000225 | 232 | 271 | 7 | 8 |
| AT3G06720.1 | HMMPfam | PF00514 | Arm | IPR000225 | 189 | 230 | 7 | 8 |
| AT3G06720.1 | HMMPfam | PF00514 | Arm | IPR000225 | 147 | 187 | 7 | 8 |
| AT3G06720.1 | HMMPfam | PF00514 | Arm | IPR000225 | 104 | 145 | 7 | 8 |

Homologues of SEQ ID NO: 7 and SEQ ID NO: 8

| Name homologue | Nucleic acid SEQ ID NO: | Polypeptide SEQ ID NO: |
|---|---|---|
| >B.napus_TC67085#1 | 43 | 44 |
| >G.max_Glyma15g15480.1#1 | 45 | 46 |
| >G.hirsutum_ES815460#1 | 47 | 48 |
| >H.vulgare_TC178368#1 | 49 | 50 |
| >M.truncatula_AC191599_15.4#1 | 51 | 52 |
| >O.sativa_Os01g0253300#1 | 53 | 54 |
| >P.patens_TC52982#1 | 55 | 56 |
| >P.trichocarpa_833349#1 | 57 | 58 |
| >S.lycopersicum_TC192018#1 | 59 | 60 |
| >T.aestivum_TC285294#1 | 61 | 62 |
| >Z.mays_c62040840gm030403@6670#1 | 63 | 64 |

| Accession number of homologue | Database | Domain accession | Domain name | InterPro accession | amino acid start coordinate | amino acid end coordinate | SEQ ID NO | SEQ ID NO |
|---|---|---|---|---|---|---|---|---|
| AT4G16143.1 | Seg | Seg | seg | NULL | 333 | 340 | 9 | 10 |
| AT4G16143.1 | HMMPanther | PTHR23316 | IMPORTIN ALPHA | NULL | 1 | 534 | 9 | 10 |
| AT4G16143.1 | superfamily | SSF48371 | ARM repeat | IPR016024 | 77 | 499 | 9 | 10 |
| AT4G16143.1 | Gene3D | G3DSA:1.25.10.10no | description | IPR011989 | 77 | 499 | 9 | 10 |
| AT4G16143.1 | ProfileScan | PS51214 | IBB | IPR002652 | 1 | 58 | 9 | 10 |
| AT4G16143.1 | HMMPfam | PF01749 | IBB | IPR002652 | 4 | 100 | 9 | 10 |
| AT4G16143.1 | ProfileScan | PS50176 | ARM_REPEAT | IPR000225 | 331 | 374 | 9 | 10 |
| AT4G16143.1 | ProfileScan | PS50176 | ARM_REPEAT | IPR000225 | 289 | 331 | 9 | 10 |
| AT4G16143.1 | ProfileScan | PS50176 | ARM_REPEAT | IPR000225 | 247 | 289 | 9 | 10 |
| AT4G16143.1 | ProfileScan | PS50176 | ARM_REPEAT | IPR000225 | 163 | 205 | 9 | 10 |
| AT4G16143.1 | ProfileScan | PS50176 | ARM_REPEAT | IPR000225 | 120 | 163 | 9 | 10 |
| AT4G16143.1 | HMMSmart | SM00185 | no description | IPR000225 | 406 | 446 | 9 | 10 |
| AT4G16143.1 | HMMSmart | SM00185 | no description | IPR000225 | 363 | 403 | 9 | 10 |
| AT4G16143.1 | HMMSmart | SM00185 | no description | IPR000225 | 320 | 361 | 9 | 10 |
| AT4G16143.1 | HMMSmart | SM00185 | no description | IPR000225 | 278 | 318 | 9 | 10 |
| AT4G16143.1 | HMMSmart | SM00185 | no description | IPR000225 | 237 | 276 | 9 | 10 |
| AT4G16143.1 | HMMSmart | SM00185 | no description | IPR000225 | 193 | 235 | 9 | 10 |
| AT4G16143.1 | HMMSmart | SM00185 | no description | IPR000225 | 152 | 192 | 9 | 10 |
| AT4G16143.1 | HMMSmart | SM00185 | no description | IPR000225 | 109 | 150 | 9 | 10 |
| AT4G16143.1 | HMMPfam | PF00514 | Arm | IPR000225 | 406 | 446 | 9 | 10 |
| AT4G16143.1 | HMMPfam | PF00514 | Arm | IPR000225 | 363 | 403 | 9 | 10 |
| AT4G16143.1 | HMMPfam | PF00514 | Arm | IPR000225 | 320 | 361 | 9 | 10 |
| AT4G16143.1 | HMMPfam | PF00514 | Arm | IPR000225 | 278 | 318 | 9 | 10 |
| AT4G16143.1 | HMMPfam | PF00514 | Arm | IPR000225 | 237 | 276 | 9 | 10 |
| AT4G16143.1 | HMMPfam | PF00514 | Arm | IPR000225 | 194 | 235 | 9 | 10 |
| AT4G16143.1 | HMMPfam | PF00514 | Arm | IPR000225 | 152 | 192 | 9 | 10 |
| AT4G16143.1 | HMMPfam | PF00514 | Arm | IPR000225 | 109 | 150 | 9 | 10 |

Homologues of SEQ ID NO: 9 and SEQ ID NO: 10

| Name homologue | Nucleic acid SEQ ID NO: | Polypeptide SEQ ID NO: |
|---|---|---|
| >B.napus_TC67085#1 | 65 | 66 |
| >G.hirsutum_ES815460#1 | 67 | 68 |
| >G.max_Glyma17g03430.1#1 | 69 | 70 |
| >H.vulgare_TC178368#1 | 71 | 72 |
| >M.truncatula_AC191599_15.4#1 | 73 | 74 |
| >O.sativa_LOC_Os01g14950.1#1 | 75 | 76 |
| >P.patens_218909#1 | 77 | 78 |
| >P.trichocarpa_833349#1 | 79 | 80 |
| >S.lycopersicum_TC192018#1 | 81 | 82 |
| >T.aestivum_TC285294#1 | 83 | 84 |
| >Z.mays_TC468320#1 | 85 | 86 |

TABLE 3b

InterPro scan results (major accession numbers) of the AT1G18450.1 polypeptide, homologue of SEQ ID NO: 124 and SEQ ID NO:125

| Accession number of homologue | Database | Domain accession | Domain name | InterPro accession | amino acid start coordinate | amino acid end coordinate |
|---|---|---|---|---|---|---|
| AT1G18450.1 | superfamily | SSF53067 | SSF53067 | NULL | 170 | 441 |
| AT1G18450.1 | HMMPanther | PTHR11937:SF32 | PTHR11937:SF32 | NULL | 254 | 441 |
| AT1G18450.1 | superfamily | SSF53067 | SSF53067 | NULL | 3 | 170 |
| AT1G18450.1 | HMMPanther | PTHR11937:SF32 | PTHR11937:SF32 | NULL | 74 | 223 |
| AT1G18450.1 | HMMPanther | PTHR11937:SF32 | PTHR11937:SF32 | NULL | 31 | 441 |
| AT1G18450.1 | HMMPanther | PTHR11937:SF32 | PTHR11937:SF32 | NULL | 31 | 52 |
| AT1G18450.1 | Gene3D | G3DSA:3.30.420.40G3DSA:3.30.420.40 | | NULL | 404 | 441 |
| AT1G18450.1 | Gene3D | G3DSA:3.30.420.40G3DSA:3.30.420.40 | | NULL | 296 | 387 |
| AT1G18450.1 | Gene3D | G3DSA:3.30.420.40G3DSA:3.30.420.40 | | NULL | 3 | 164 |
| AT1G18450.1 | HMMSmart | SM00268 | ACTIN | IPR004000 | 7 | 441 |
| AT1G18450.1 | HMMPfam | PF00022 | Actin | IPR004000 | 4 | 441 |
| AT1G18450.1 | HMMPanther | PTHR11937 | Actin_like | IPR004000 | 31 | 441 |

Homologues of SEQ ID NO: 124 and SEQ ID NO: 125

| Name homologue | Nucleic acid SEQ ID NO: | Polypeptide SEQ ID NO: |
|---|---|---|
| >AT1G18450.1 | 136 | 137 |
| >B.napus__BN06MC30721__51397463@30594#1 | 138 | 139 |
| >G.max__TC298093#1 | 140 | 141 |
| >G.hirsutum__TC140956#1 | 142 | 143 |
| >H.vulgare__c62682376hv270303@11037#1 | 144 | 145 |
| >M.truncatula__CU179920__30.3#1 | 146 | 147 |
| >O.sativa__Os08g0137200#1 | 148 | 149 |
| >P.patens__TC46936#1 | 150 | 151 |
| >P.trichocarpa__scaff__XII.526#1 | 152 | 153 |
| >S.lycopersicum__TC191897#1 | 154 | 155 |
| >T.aestivum__TC318743#1 | 156 | 157 |
| >Z.mays__ZM07MC12195__62264430@12170#1 | 158 | 159 |

TABLE 4a

Homologues of SEQ ID NO: 4 and corresponding InterPro scan results (major accession numbers)

| Accession number of homologue | Database | Domain accession | Domain name | InterPro accession | amino acid start coordinate | amino acid end coordinate | SEQ ID NO | SEQ ID NO |
|---|---|---|---|---|---|---|---|---|
| AT5G53480.1 | HMMPanther | PTHR10527:SF1 | PTHR10527:SF1 | NULL | 217 | 869 | 11 | 12 |
| AT5G53480.1 | HMMPanther | PTHR10527:SF1 | PTHR10527:SF1 | NULL | 217 | 869 | 11 | 12 |
| AT5G53480.1 | HMMPanther | PTHR10527 | PTHR10527 | NULL | 217 | 869 | 11 | 12 |
| AT5G53480.1 | HMMPanther | PTHR10527 | PTHR10527 | NULL | 217 | 869 | 11 | 12 |
| AT5G53480.1 | superfamily | SSF48371 | ARM-type_fold | IPR016024 | 3 | 864 | 11 | 12 |
| AT5G53480.1 | Gene3D | G3DSA:1.25.10.10ARM-like | | IPR011989 | 3 | 866 | 11 | 12 |
| AT5G53480.1 | ProfileScan | PS50166 | IMPORTIN_B_NT | IPR001494 | 23 | 103 | 11 | 12 |
| AT5G53480.1 | HMMPfam | PF03810 | IBN_N | IPR001494 | 23 | 103 | 11 | 12 |
| AT5G53480.1 | HMMPfam | PF02985 | HEAT | IPR000357 | 404 | 441 | 11 | 12 |
| AT5G53480.1 | HMMPfam | PF02985 | HEAT | IPR000357 | 362 | 398 | 11 | 12 |
| AT5G53480.1 | HMMPfam | PF02985 | HEAT | IPR000357 | 214 | 250 | 11 | 12 |

Homologues of SEQ ID NO: 11 and SEQ ID NO: 12

| Name homologue | Nucleic acid SEQ ID NO: | Polypeptide SEQ ID NO: |
|---|---|---|
| >A.thaliana__AT3G08943.1#1 | 87 | 88 |
| >A.thaliana__AT3G08947.1#1 | 89 | 90 |
| >G.max__Glyma04g41230.1#1 | 91 | 92 |
| >G.max__Glyma05g36630.1#1 | 93 | 94 |
| >G.max__Glyma06g13620.1#1 | 95 | 96 |
| >G.max__Glyma08g02930.1#1 | 97 | 98 |
| >H.vulgare__c62767390hv270303@6375#1 | 99 | 100 |
| >H.vulgare AK249047 | 101 | 102 |
| >O.sativa__LOC__Os12g38110.1#1 | 103 | 104 |
| >P.patens__TC30184#1 | 105 | 106 |
| >P.patens__TC31822#1 | 107 | 108 |
| >P.trichocarpa__scaff__VI.900#1 | 109 | 110 |
| >P.trichocarpa__scaff__XII.230#1 | 111 | 112 |
| >P.trichocarpa__scaff__XV.118#1 | 113 | 114 |

TABLE 4a-continued

| | | |
|---|---|---|
| >P.trichocarpa_scaff_XVI.1174#1 | 115 | 116 |
| >S.bicolor_XM_002442302.1 | 117 | 118 |

TABLE 4b

InterPro scan results (major accession numbers) of the AT1G05370.1 polypeptide, homologue of SEQ ID NO: 126 and SEQ ID NO: 127

| Accession number of homologue | Database | Domain accession | Domain name | InterPro accession | amino acid start coordinate | amino acid end coordinate |
|---|---|---|---|---|---|---|
| AT1G05370.1 | TMHMM | tmhmm | transmembrane_regions | NULL | 170 | 191 |
| AT1G05370.1 | TMHMM | tmhmm | transmembrane_regions | NULL | 144 | 166 |
| AT1G05370.1 | Seg | seg | seg | NULL | 318 | 330 |
| AT1G05370.1 | Seg | seg | seg | NULL | 235 | 256 |
| AT1G05370.1 | Seg | seg | seg | NULL | 150 | 163 |
| AT1G05370.1 | HMMPanther | PTHR10174 | RETINALDEHYDE BINDING PROTEIN-RELATED | NULL | 18 | 150 |
| AT1G05370.1 | superfamily | SSF46938 | CRAL/TRIO N-terminal domain | IPR011074 | 14 | 83 |
| AT1G05370.1 | superfamily | SSF52087 | CRAL/TRIO domain | IPR001251 | 82 | 149 |
| AT1G05370.1 | ProfileScan | PS50191 | CRAL_TRIO | IPR001251 | 80 | 262 |
| AT1G05370.1 | HMMSmart | SM00516 | no description | IPR001251 | 86 | 229 |
| AT1G05370.1 | Gene3D | G3DSA:3.40.525.10 | no description | IPR001251 | 70 | 149 |
| AT1G08730.1 | superfamily | SSF54849 | GroEL-intermediate domain like | NULL | 940 | 1017 |

Homologues of SEQ ID NO: 126 and SEQ ID NO: 127

| Name homologue | Nucleic acid SEQ ID NO: | Polypeptide SEQ ID NO: |
|---|---|---|
| G.max_Glyma20g28380.3#1 | 160 | 161 |
| M.truncatula_AC161569_9.5#1 | 162 | 163 |
| O.sativa_Os03g0219100#1 | 164 | 165 |
| P.patens_NP13131528#1 | 166 | 167 |
| P.trichocarpa_scaff_X.810#1 | 168 | 169 |
| Z.mays_ZM07MC22382_BFb0062G18@22320#1 | 170 | 171 |

TABLE 5

InterPro scan results (major accession numbers) of the AT2G18876.2 polypeptide, homologue of SEQ ID NO: 128 and SEQ ID NO: 129

| Accession number of homologue | Database | Domain accession | Domain name | InterPro accession | amino acid start coordinate | amino acid end coordinate |
|---|---|---|---|---|---|---|
| AT2G18876.2 | HMMPanther | PTHR21736:SF12 | PTHR21736:SF12 | NULL | 64 | 284 |
| AT2G18876.2 | HMMPanther | PTHR21736:SF12 | PTHR21736:SF12 | NULL | 64 | 284 |
| AT2G18876.2 | HMMPanther | PTHR21736 | PTHR21736 | NULL | 64 | 284 |
| AT2G18876.2 | HMMPanther | PTHR21736 | PTHR21736 | NULL | 64 | 284 |

Homologues of SEQ ID NO: 128 and SEQ ID NO: 129

| Name homologue | Nucleic acid SEQ ID NO: | Polypeptide SEQ ID NO: |
|---|---|---|
| >AT2G18876.2 | 172 | 173 |
| >Zeama_Ssxt2IP | 174 | 175 |
| >B.napus_TC73647#1 | 176 | 177 |
| >G.max_Glyma17g07040.1#1 | 178 | 179 |
| >M.truncatula_TC118724#1 | 180 | 181 |
| >O.sativa_Os08g0242900#1 | 182 | 183 |
| >P.patens_186245#1 | 184 | 185 |
| >P.trichocarpa_825889#1 | 186 | 187 |
| >Z.mays_TC516387#1 | 188 | 189 |

TABLE 6

InterPro scan results (major accession numbers) of the AT3G60830.1 polypeptide, homologue of SEQ ID NO: 130 and SEQ ID NO: 131

| Accession number of homologue | Database | Domain accession | Domain name | InterPro accession | amino acid start coordinate | amino acid end coordinate |
|---|---|---|---|---|---|---|
| AT3G60830.1 | superfamily | SSF53067 | SSF53067 | NULL | 135 | 363 |
| AT3G60830.1 | superfamily | SSF53067 | SSF53067 | NULL | 1 | 141 |
| AT3G60830.1 | HMMPanther | PTHR11937:SF26 | PTHR11937:SF26 | NULL | 20 | 363 |

TABLE 6-continued

| | | | | | | |
|---|---|---|---|---|---|---|
| AT3G60830.1 | HMMPanther | PTHR11937:SF26 | PTHR11937:SF26 | NULL | 20 | 363 |
| AT3G60830.1 | Gene3D | G3DSA:3.30.420.40G3DSA:3.30.420.40 | | NULL | 325 | 363 |
| AT3G60830.1 | Gene3D | G3DSA:3.30.420.40G3DSA:3.30.420.40 | | NULL | 228 | 300 |
| AT3G60830.1 | Gene3D | G3DSA:3.30.420.40G3DSA:3.30.420.40 | | NULL | 3 | 128 |
| AT3G60830.1 | HMMSmart | SM00268 | ACTIN | IPR004000 | 1 | 363 |
| AT3G60830.1 | HMMPfam | PF00022 | Actin | IPR004000 | 3 | 363 |
| AT3G60830.1 | HMMPanther | PTHR11937 | Actin_like | IPR004000 | 20 | 363 |
| AT3G60830.1 | FPrintScan | PR00190 | ACTIN | IPR004000 | 219 | 235 |
| AT3G60830.1 | FPrintScan | PR00190 | ACTIN | IPR004000 | 128 | 147 |
| AT3G60830.1 | FPrintScan | PR00190 | ACTIN | IPR004000 | 103 | 116 |
| AT3G60830.1 | FPrintScan | PR00190 | ACTIN | IPR004000 | 23 | 32 |

Homologues of SEQ ID NO: 130 and SEQ ID NO: 131

| Name homologue | Nucleic acid SEQ ID NO: | Polypeptide SEQ ID NO: |
|---|---|---|
| >B.napus__TC83795#1 | 190 | 191 |
| >G.hirsutum__ES802301#1 | 192 | 193 |
| >G.max__Glyma12g01010.1#1 | 194 | 195 |
| >M.truncatula__TC123694#1 | 196 | 197 |
| >O.sativa__TC300228#1 | 198 | 199 |
| >P.patens__TC39330#1 | 200 | 201 |
| >P.trichocarpa__TC89949#1 | 202 | 203 |
| >S.lycopersicum__TC194794#1 | 204 | 205 |
| >T.aestivum__TC308484#1 | 206 | 207 |
| >Z.mays__TC515322#1 | 208 | 209 |

TABLE 7

Homologues of SEQ ID NO: 132 and SEQ ID NO: 133

| Name homologue | Nucleic acid SEQ ID NO: | Polypeptide SEQ ID NO: |
|---|---|---|
| >B.napus__EE448802#1 | 210 | 211 |
| >G.max__TC316889#1 | 212 | 213 |
| >M.truncatula__TC114019#1 | 214 | 215 |
| >O.sativa__LOC__Os10g41030.3#1 | 216 | 217 |
| >P.trichocarpa__scaff__29.51#1 | 218 | 219 |

TABLE 8

InterPro scan results (major accession numbers) of the AT5G13030.1 polypeptide, homologue of SEQ ID NO: 134 and SEQ ID NO: 135

| Accession number of homologue | Database | Domain accession | Domain name | InterPro accession | amino acid start coordinate | amino acid end coordinate |
|---|---|---|---|---|---|---|
| AT5G13030.1 | HMMPfam | PF02696 | UPF0061 | IPR003846 | 108 | 604 |
| AT5G13030.1 | HMMPanther | PTHR13844 | PTHR13844 | NULL | 250 | 523 |
| AT5G13030.1 | HMMPanther | PTHR13844 | PTHR13844 | NULL | 250 | 523 |
| AT5G13030.1 | superfamily | SSF47592 | MDM2 | IPR003121 | 308 | 400 |
| AT5G13030.1 | HMMPfam | PF02201 | SWIB | IPR003121 | 315 | 390 |
| AT5G13030.1 | Gene3D | G3DSA:1.10.245.10SWIB__MDM2 | | IPR003121 | 308 | 400 |

Homologues of SEQ ID NO: 134 and SEQ ID NO: 135

| Name homologue | Nucleic acid SEQ ID NO: | Polypeptide SEQ ID NO: |
|---|---|---|
| >B.napus__TC91422#1 | 220 | 221 |
| >G.max__Glyma20g39090.1#1 | 222 | 223 |
| >G.hirsutum__TC174829#1 | 224 | 225 |
| >M.truncatula__AC149471__14.5#1 | 226 | 227 |
| >O.sativa__TC288127#1 | 228 | 229 |
| >P.patens__TC30567#1 | 230 | 231 |
| >P.trichocarpa__scaff__I.133#1 | 232 | 233 |
| >T.aestivum__c54479201@7744#1 | 234 | 235 |
| >Z.mays__ZM07MC31636__BFb0358L02@31542#1 | 236 | 237 |

Additionally or alternatively, the homologue of an importin protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 2 or SEQ ID NO: 4, or to any of the SEQ ID NOs in Tables 3 a and 4a.

Additionally or alternatively, the homologue of a yield-related protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 125, 127, 129, 131, 133 or 135, or to any of the SEQ ID NOs in Tables 3 b, 4 b, 5, 6, 7 and 8.

The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

The terms "domain", "signature" and "motif" are defined in the "definitions" section herein.

Preferably, the polypeptide sequence which when used in the construction of a phylogenetic tree clusters with other importin polypeptides, the cluster comprising the amino acid sequence represented by SEQ ID NO: 2 or SEQ ID NO: 4.

In addition, importin polypeptides, when expressed in rice according to the methods of the present invention as outlined in the Examples section, give plants having increased yield related traits.

Preferably, the polypeptide sequence which when used in the construction of a phylogenetic tree clusters with other yield related polypeptides comprising the amino acid sequence represented by SEQ ID NO: 125, 127, 129, 131, 133 or 135.

In addition, yield related polypeptides, when expressed in rice according to the methods of the present invention as outlined in the Examples section herein, give plants having increased yield related traits.

The present invention is illustrated by transforming plants with the nucleic acid sequence represented by SEQ ID NO: 1, encoding the polypeptide sequence of SEQ ID NO: 2 and by transforming plants with the nucleic acid sequence represented by SEQ ID NO: 3, encoding the polypeptide sequence of SEQ ID NO: 4. However, performance of the invention is not restricted to these sequences; the methods of the invention may advantageously be performed using any importin-encoding nucleic acid or importin polypeptide as defined herein.

Examples of nucleic acids encoding importin polypeptides are given in Tables 3 a and 4 a herein. Such nucleic acids are useful in performing the methods of the invention. The amino acid sequences given in Tables 3 a and 4 a of the Examples section are example sequences of orthologues and paralogues of the importin polypeptide represented by SEQ ID NO: 2 and SEQ ID NO: 4, the terms "orthologues" and "paralogues" being as defined herein. Further orthologues and paralogues may readily be identified by performing a so-called reciprocal blast search as described in the definitions section; where the query sequence is SEQ ID NO: 1, SEQ ID NO: 2, SEQ ID NO: 3 or SEQ ID NO: 4, the second BLAST (back-BLAST) would be against *Populus trichocarpa* sequences.

The present invention is illustrated by transforming plants with the nucleic acid sequence represented by SEQ ID NO: 124, 126, 128, 130, 132 and 134, encoding the polypeptide sequence of SEQ ID NO: 125, 127, 129, 131, 133, or 135 respectively. However, performance of the invention is not restricted to these sequences; the methods of the invention may advantageously be performed using any yield related encoding nucleic acid or yield related polypeptide as defined herein.

Examples of nucleic acids encoding yield related polypeptides are given in Tables 3 b, 4 b, 5, 6, 7 and 8. Such nucleic acids are useful in performing the methods of the invention. The amino acid sequences given in Tables 3 b, 4 b, 5, 6, 7 and 8 are example sequences of orthologues and paralogues of the yield related polypeptide represented by SEQ ID NO: 125, 127, 129, 131, 133, or 135, the terms "orthologues" and "paralogues" being as defined herein. Further orthologues and paralogues may readily be identified by performing a so-called reciprocal blast search as described in the definitions section; where the query sequence is SEQ ID NO: 124, SEQ ID NO: 125, the second BLAST (back-BLAST) would be against *Populus trichocarpa* sequences.

The invention also provides hitherto unknown importin- or yield related-encoding nucleic acids and importin or yield related polypeptides useful for conferring enhanced yield-related traits in plants relative to control plants.

According to a further embodiment of the present invention, there is therefore provided an isolated nucleic acid molecule selected from:
(i) a nucleic acid represented by SEQ ID NO: 1 or SEQ ID NO: 3;
(ii) the complement of a nucleic acid represented by SEQ ID NO: 1 or SEQ ID NO: 3;
(iii) a nucleic acid encoding an importin polypeptide having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 2 or SEQ ID NO: 4.
(iv) a nucleic acid molecule which hybridizes with a nucleic acid molecule of (i) to (iii) under high stringency hybridization conditions and preferably confers enhanced yield-related traits relative to control plants.

According to a further embodiment of the present invention, there is also provided an isolated polypeptide selected from:
(i) an amino acid sequence represented by SEQ ID NO: 2 or SEQ ID NO: 4;
(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by SEQ ID NO: 2 or SEQ ID NO: 4;
(iii) derivatives of any of the amino acid sequences given in (i) or (ii) above.

According to a further embodiment of the present invention, there is therefore provided an isolated nucleic acid molecule selected from:
(i) a nucleic acid represented by any of SEQ ID NO: 124, 126, 128, 130, 132 and 134;
(ii) the complement of a nucleic acid represented by any of SEQ ID NO: 124, 126, 128, 130, 132 and 134;
(iii) a nucleic acid encoding an yield-related polypeptide having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any of SEQ ID NO: 125, 127, 129, 131, 133, or 135.
(iv) a nucleic acid molecule which hybridizes with a nucleic acid molecule of (i) to (iii) under high stringency hybridization conditions and preferably confers enhanced yield-related traits relative to control plants.

According to a further embodiment of the present invention, there is also provided an isolated polypeptide selected from:
(i) an amino acid sequence represented by any of SEQ ID NO: 125, 127, 129, 131, 133, or 135;
(ii) an amino acid sequence having, in increasing order of preference, at least 50%, 51%, 52%, 53%, 54%, 55%, 56%, 57%, 58%, 59%, 60%, 81%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any of SEQ ID NO: 125, 127, 129, 131, 133, or 135;
(iii) derivatives of any of the amino acid sequences given in (i) or (ii) above.

Nucleic acid variants may also be useful in practising the methods of the invention. Examples of such variants include nucleic acids encoding homologues and derivatives of SEQ ID NO: 2 or 4 or of any one of the amino acid sequences given in Tables 3 a or 4 a, the terms "homologue" and "derivative" being as defined herein. Also useful in the methods of the invention are nucleic acids encoding homologues and derivatives of orthologues or paralogues of SEQ ID NO: 2 or 4 or of any one of the amino acid sequences given in Tables 3a or 4a. Homologues and derivatives useful in the methods of the present invention have substantially the same biological and functional activity as the unmodified protein from which they are derived. Further variants useful in practising the methods of the invention are variants in which codon usage is optimised or in which miRNA target sites are removed.

Nucleic acid variants may also be useful in practising the methods of the invention. Examples of such variants include nucleic acids encoding homologues and derivatives of any of SEQ ID NO: 125, 127, 129, 131, 133 or 135 or of any one of the amino acid sequences given in Tables 3b, 4b, 5, 6, 7, 8, the terms "homologue" and "derivative" being as defined herein. Also useful in the methods of the invention are nucleic acids encoding homologues and derivatives of orthologues or paralogues of SEQ ID NO: 125, 127, 129, 131, 133 or 135, or of any one of the amino acid sequences given in Tables 3 b, 4 b, 5, 6, 7 or 8. Homologues and derivatives useful in the methods of the present invention have substantially the same biological and functional activity as the unmodified protein from which they are derived. Further variants useful in practising the methods of the invention are variants in which codon usage is optimised or in which miRNA target sites are removed.

Further nucleic acid variants useful in practising the methods of the invention include portions of nucleic acids encoding importin or yield related polypeptides, nucleic acids hybridising to nucleic acids encoding importin or yield related polypeptides, splice variants of nucleic acids encoding importin or yield related polypeptides, allelic variants of nucleic acids encoding importin or yield related polypeptides and variants of nucleic acids encoding importin or yield related polypeptides obtained by gene shuffling. The terms hybridising sequence, splice variant, allelic variant and gene shuffling are as described herein.

Nucleic acids encoding importin polypeptides need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of SEQ ID NO: 1 or 3 or of a nucleic acid encoding any one of the amino acid sequences given in Tables 3 a or 4 a, or a portion of a nucleic acid encoding an orthologue, paralogue or homologue of any of the amino acid sequences given in Tables 3 a or 4 a.

Nucleic acids encoding yield related polypeptides need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of SEQ ID NO: 124, 126, 128, 130, 132 or 134, or of a nucleic acid encoding any one of the amino acid sequences given in Tables 3 b, 4 b, 5, 6, 7 or 8, or a portion of a nucleic acid encoding an orthologue, paralogue or homologue of any of the amino acid sequences given in Tables 3 b, 4 b, 5, 6, 7 or 8.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Portions useful in the methods of the invention, encode an importin polypeptide as defined herein, and have substantially the same biological activity as the amino acid sequences given in Tables 3 a and 4 a herein. Preferably, the portion is a portion of any one of the nucleic acids given in Tables 3 a and 4 a herein, or is a portion of a nucleic acid encoding an orthologue or paralogue of any one of the amino acid sequences given in Tables 3 a and 4 a herein. Preferably the portion is at least 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2150, 2200, 2250, 2300 consecutive nucleotides in length, the consecutive nucleotides being of any one of SEQ ID NO: 1 or 3 or of any one of the nucleic acid sequences given in Tables 3 a or 4 a, or of a nucleic acid encoding an orthologue or paralogue of any one of SEQ ID NO: 2 or 4 or of any one of the amino acid sequences given in Tables 3 a and 4 a. Most preferably the portion is a portion of the nucleic acid of SEQ ID NO: 1 or SEQ ID NO: 3. Preferably, the portion encodes a fragment of an amino acid sequence which, when used in the construction of a phylogenetic tree clusters with the group of importin polypeptides comprising the amino acid sequence represented by SEQ ID NO: 2 or SEQ ID NO: 4.

Portions useful in the methods of the invention, encode a yield-related polypeptide as defined herein, and have substantially the same biological activity as the amino acid sequences given in Tables 3 b, 4 b, 5, 6, 7 and 8. Preferably, the portion is a portion of any one of the nucleic acids given in Tables 3 b, 4 b, 5, 6, 7 and 8, or is a portion of a nucleic acid encoding an orthologue or paralogue of any one of the amino acid sequences given in Tables 3 b, 4 b, 5, 6, 7 and 8. Preferably the portion is at least 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2150, 2200, 2250, 2300 consecutive nucleotides in length, the consecutive nucleotides being of any one of SEQ ID NO: 124 or 126 or of any one of the nucleic acid sequences given in Tables 3 b, 4 b, 5, 6, 7 or 8, or of a nucleic acid encoding an orthologue or paralogue of any one of SEQ ID NO: 125, 127, 129, 131, 133 or 135, or of any one of the amino acid sequences given in Tables 3 b, 4 b, 5, 6, 7 and 8. Most preferably the portion is a portion of any of the nucleic acid of SEQ ID NO: 124, 126, 128, 130, 132 or 134. Preferably, the portion encodes a fragment of an amino acid sequence which, when used in the construction of a phylogenetic tree clusters with the group of yield related polypeptides comprising any one of the amino acid sequences represented by SEQ ID NO: 125, 127, 129, 131, 133 or 135.

Another nucleic acid variant useful in the methods of the invention is a nucleic acid capable of hybridising, under reduced stringency conditions, preferably under stringent conditions, with a nucleic acid encoding an importin or a yield related polypeptide as defined herein, or with a portion as defined herein.

According to the present invention, there is provided a method for enhancing yield-related traits in plants, comprising introducing and expressing in a plant a nucleic acid capable of hybridizing to SEQ ID NO: 1 or 3 or to any one of the nucleic acids given in Tables 3 a or 4 a, or comprising introducing and expressing in a plant a nucleic acid capable of hybridising to a nucleic acid encoding an orthologue, paralogue or homologue of any of the nucleic acid sequences given in Tables 3 a or 4 a.

According to the present invention, there is provided a method for enhancing yield-related traits in plants, comprising introducing and expressing in a plant a nucleic acid capable of hybridizing to SEQ ID NO: 124, 126, 128, 130, 132, or 134, or to any one of the nucleic acids given in Tables 3 b, 4 b, 5, 6, 7 or 8, or comprising introducing and expressing in a plant a nucleic acid capable of hybridising to a nucleic acid encoding an orthologue, paralogue or homologue of any of the nucleic acid sequences given in Tables 3 b, 4 b, 5, 6, 7 or 8.

Hybridising sequences useful in the methods of the invention encode an importin polypeptide as defined herein, having substantially the same biological activity as the amino acid sequences given in Tables 3 a or 4 a. Preferably, the hybridising sequence is capable of hybridising to the complement of any one of the nucleic acids given in Tables 3 or 4, or to a portion of any of these sequences, a portion being as defined above, or the hybridising sequence is capable of hybridising to the complement of a nucleic acid encoding an orthologue or paralogue of any one of the amino acid sequences given in Tables 3 a or 4 a. Most preferably, the hybridising sequence is capable of hybridising to the complement of a nucleic acid as represented by SEQ ID NO: 1 or SEQ ID NO: 3 or to a portion thereof.

Hybridising sequences useful in the methods of the invention encode a yield related polypeptide as defined herein, having substantially the same biological activity as the amino acid sequences given in Tables 3 b, 4 b, 5, 6, 7 or 8. Preferably, the hybridising sequence is capable of hybridising to the complement of any one of the nucleic acids given in Tables 3 b, 4 b, 5, 6, 7 or 8, or to a portion of any of these sequences, a portion being as defined above, or the hybridising sequence is capable of hybridising to the complement of a nucleic acid encoding an orthologue or paralogue of any one of the amino acid sequences given in Tables 3 b, 4 b, 5, 6, 7 or 8. Most preferably, the hybridising sequence is capable of hybridising to the complement of a nucleic acid as represented by SEQ ID NO: 124, 126, 128, 130, 132 or 134 or to a portion thereof.

Preferably, the hybridising sequence encodes a polypeptide with an amino acid sequence which, when full-length and used in the construction of a phylogenetic tree, clusters with the group of importin polypeptides comprising the sequence represented by SEQ ID NO: 2 or SEQ ID NO: 4.

Preferably, the hybridising sequence encodes a polypeptide with an amino acid sequence which, when full-length and used in the construction of a phylogenetic tree, clusters with one of the yield related polypeptides represented by SEQ ID NO: 125, 127, 129, 131, 133, or 135.

Another nucleic acid variant useful in the methods of the invention is a splice variant encoding an importin or a yield related polypeptide as defined hereinabove, a splice variant being as defined herein.

According to the present invention, there is provided a method for enhancing yield-related traits in plants, comprising introducing and expressing in a plant a splice variant of any one of the nucleic acid sequences given in Tables 3 a and 4 a herein, or a splice variant of a nucleic acid encoding an orthologue, paralogue or homologue of any of the amino acid sequences given in Tables 3 a and 4 a herein.

According to the present invention, there is provided a method for enhancing yield-related traits in plants, comprising introducing and expressing in a plant a splice variant of any one of the nucleic acid sequences given in Tables 3 b, 4 b, 5, 6, 7 and 8, or a splice variant of a nucleic acid encoding an orthologue, paralogue or homologue of any of the amino acid sequences given in Tables 3 b, 4 b, 5, 6, 7 and 8.

Preferred splice variants are splice variants of a nucleic acid represented by SEQ ID NO: 1 or SEQ ID NO: 3, or a splice variant of a nucleic acid encoding an orthologue or paralogue of SEQ ID NO: 2 or 4. Preferably, the amino acid sequence encoded by the splice variant, when used in the construction of a phylogenetic tree clusters with the group of importin polypeptides comprising the sequence represented by SEQ ID NO: 2 or 4.

Preferred splice variants are splice variants of a nucleic acid represented by SEQ ID NO: 124, 126, 128, 130, 132, or 134, or a splice variant of a nucleic acid encoding an orthologue or paralogue of SEQ ID NO: 125, 127, 129, 131, 133 or 135. Preferably, the amino acid sequence encoded by the splice variant, when used in the construction of a phylogenetic tree clusters with the group of yield related polypeptides selected from one of SEQ ID NO: 125, 127, 129, 131, 133 or 135.

Another nucleic acid variant useful in performing the methods of the invention is an allelic variant of a nucleic acid encoding an importin or a yield related polypeptide as defined hereinabove, an allelic variant being as defined herein.

According to the present invention, there is provided a method for enhancing yield-related traits in plants, comprising introducing and expressing in a plant an allelic variant of any one of the nucleic acids given in Tables 3 a and 4 a herein, or comprising introducing and expressing in a plant an allelic variant of a nucleic acid encoding an orthologue, paralogue or homologue of any of the amino acid sequences given in Tables 3 a and 4 a herein.

According to the present invention, there is provided a method for enhancing yield-related traits in plants, comprising introducing and expressing in a plant an allelic variant of any one of the nucleic acids given in Tables 3 b, 4 b, 5, 6, 7 and 8, or comprising introducing and expressing in a plant an allelic variant of a nucleic acid encoding an orthologue, paralogue or homologue of any of the amino acid sequences given in Tables 3 b, 4 b, 5, 6, 7 and 8.

The polypeptides encoded by allelic variants useful in the methods of the present invention have substantially the same biological activity as the importin polypeptide of SEQ ID NO: 2 or 4 and to any one of the amino acids depicted in Tables 3 a and 4 a. Allelic variants exist in nature, and encompassed within the methods of the present invention is the use of these natural alleles. Preferably, the allelic variant is an allelic variant of SEQ ID NO: 1 or 3 or an allelic variant of a nucleic acid encoding an orthologue or paralogue of SEQ ID NO: 2 or 4. Preferably, the amino acid sequence encoded by the allelic variant, when used in the construction of a phylogenetic tree clusters with the importin polypeptides, the cluster comprising the amino acid sequence represented by SEQ ID NO: 2 or 4.

The polypeptides encoded by allelic variants useful in the methods of the present invention have substantially the same biological activity as any one of the yield related polypeptide of SEQ ID NO: 125, 127, 129, 131, 133 or 135, or to any one of the amino acids depicted in Tables 3 b, 4 b, 5, 6, 7 and 8. Allelic variants exist in nature, and encompassed within the methods of the present invention is the use of these natural alleles. Preferably, the allelic variant is an allelic variant of SEQ ID NO: 124, 126, 128, 130, 132 or 134, or an allelic variant of a nucleic acid encoding an orthologue or paralogue of SEQ ID NO: 125, 127, 129, 131, 133 or 135. Preferably, the amino acid sequence encoded by the allelic variant, when used in the construction of a phylogenetic tree clusters with the yield related polypeptides comprising the amino acid sequence represented by SEQ ID NO: 125, 127, 129, 131, 133 or 135.

Gene shuffling or directed evolution may also be used to generate variants of nucleic acids encoding importin or yield related polypeptides as defined above; the term "gene shuffling" being as defined herein.

According to the present invention, there is provided a method for enhancing yield-related traits in plants, comprising introducing and expressing in a plant a variant of SEQ ID NO: 1 or 3 or of any one of the nucleic acid sequences given in Tables 3 a or 4 a, or comprising introducing and expressing in a plant a variant of a nucleic acid encoding an orthologue, paralogue or homologue of SEQ ID NO: 2 or 4 or of any of the amino acid sequences given in Tables 3 a or 4 a, which variant nucleic acid is obtained by gene shuffling.

According to the present invention, there is provided a method for enhancing yield-related traits in plants, comprising introducing and expressing in a plant a variant of SEQ ID NO: 124, 126, 128, 130, 132, or 134, or a variant of any one of the nucleic acid sequences given in Tables 3 b, 4 b, 5, 6, 7 or 8, or comprising introducing and expressing in a plant a variant of a nucleic acid encoding an orthologue, paralogue or homologue of SEQ ID NO: 125, 127, 129, 131, 133 or 135, or of any of the amino acid sequences given in Tables 3 b, 4 b, 5, 6, 7 or 8, which variant nucleic acid is obtained by gene shuffling.

Preferably, the amino acid sequence encoded by the variant nucleic acid obtained by gene shuffling, when used in the construction of a phylogenetic tree clusters with the group of importin polypeptides comprising the sequence represented by SEQ ID NO: 2 or 4.

Preferably, the amino acid sequence encoded by the variant nucleic acid obtained by gene shuffling, when used in the construction of a phylogenetic tree clusters with the group of yield related polypeptides represented by SEQ ID NO: 125, 127, 129, 131, 133 or 135.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding importin or yield related polypeptides may be derived from any natural or artificial source. The nucleic acid may be modified from its native form in composition and/or genomic environment through deliberate human manipulation. Preferably the importin or yield related polypeptide-encoding nucleic acid is from a plant, further preferably from a dicotyledonous plant, more preferably from the family *Populus*, most preferably the nucleic acid is from *Populus trichocarpa*.

Performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase early vigour and/or in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants.

The present invention provides a method for increasing yield, especially seed yield of plants relative to control plants, which method comprises modulating expression in a plant of a nucleic acid encoding an importin or a yield related polypeptide as defined herein.

Since the transgenic plants according to the present invention have increased yield, it is likely that these plants exhibit an increased growth rate (during at least part of their life cycle), relative to the growth rate of control plants at a corresponding stage in their life cycle.

According to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding an importin or a yield related polypeptide as defined herein.

Performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding an importin or a yield related polypeptide.

Performance of the methods of the invention gives plants grown under conditions of drought, increased yield relative to control plants grown under comparable conditions. Therefore, according to the present invention, there is provided a method for increasing yield in plants grown under conditions of drought, which method comprises modulating expression in a plant of a nucleic acid encoding an importin or a yield related polypeptide.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding an importin or a yield related polypeptide.

Performance of the methods of the invention gives plants grown under conditions of salt stress, increased yield relative to control plants grown under comparable conditions. Therefore, according to the present invention, there is provided a method for increasing yield in plants grown under conditions of salt stress, which method comprises modulating expression in a plant of a nucleic acid encoding an importin or a yield related polypeptide.

The invention also provides genetic constructs and vectors to facilitate introduction and/or expression in plants of nucleic acids encoding importin or yield related polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
 a) a nucleic acid encoding an importin or a yield related polypeptide as defined above;
 b) one or more control sequences capable of driving expression of the nucleic acid sequence of (a); and optionally
 c) a transcription termination sequence.

Preferably, the nucleic acid encoding an importin or a yield related polypeptide is as defined above. The term "control sequence" and "termination sequence" are as defined herein.

The invention furthermore provides plants transformed with a construct as described above. In particular, the invention provides plants transformed with a construct as described above, which plants have increased yield-related traits as described herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter, whether natural or synthetic, may be used to drive expression of the nucleic acid sequence, but preferably the promoter is of plant origin. A constitutive promoter is particularly useful in the methods. Preferably the constitutive promoter is a ubiquitous constitutive promoter of medium strength. See the "Definitions" section herein for definitions of the various promoter types.

It should be clear that the applicability of the present invention is not restricted to the importin polypeptide-encoding nucleic acid represented by SEQ ID NO: 1 or 3, nor is the applicability of the invention restricted to expression of an importin polypeptide-encoding nucleic acid when driven by a constitutive promoter.

It should be clear that the applicability of the present invention is not restricted to the yield related polypeptide-encoding nucleic acid represented by SEQ ID NO: 124, 126, 128, 130, 132 or 134, nor is the applicability of the invention restricted to expression of an yield related polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 119 or SEQ ID NO: 238, most preferably the constitutive promoter is as represented by SEQ ID NO: 119 or SEQ ID NO: 238. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 119 or SEQ ID NO: 238, and the nucleic acid encoding the importin or the yield related polypeptide. Furthermore, one or more sequences encoding selectable markers may be present on the construct introduced into a plant.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding an importin or a yield related polypeptide is by introducing and expressing in a plant a nucleic acid encoding an importin or a yield related polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

The invention also provides a method for the production of transgenic plants having enhanced yield-related traits relative to control plants, comprising introduction and expression in a plant of any nucleic acid encoding an importin or a yield related polypeptide as defined hereinabove.

More specifically, the present invention provides a method for the production of transgenic plants having enhanced yield-related traits, particularly increased (seed) yield, which method comprises:
 (i) introducing and expressing in a plant or plant cell an importin or a yield related polypeptide-encoding nucleic acid or a genetic construct comprising an importin or a yield related polypeptide-encoding nucleic acid; and
 (ii) cultivating the plant cell under conditions promoting plant growth and development.

The nucleic acid of (i) may be any of the nucleic acids capable of encoding an importin or a yield related polypeptide polypeptide as defined herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The present invention clearly extends to any plant cell or plant produced by any of the methods described herein, and to all plant parts and propagules thereof. The present invention encompasses plants or parts thereof (including seeds) obtainable by the methods according to the present invention. The plants or parts thereof comprise a nucleic acid transgene encoding an importin or a yield related polypeptide as defined above. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding an importin or a yield related polypeptide as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, beet, sunflower, canola, alfalfa, rapeseed, linseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, *sorghum*, emmer, spelt, *secale*, einkorn, teff, milo and oats.

The invention also extends to harvestable parts of a plant such as, but not limited to seeds, leaves, fruits, flowers, stems, roots, rhizomes, tubers and bulbs, which harvestable parts comprise a recombinant nucleic acid encoding an importin or a yield related polypeptide.

The invention furthermore relates to products derived, preferably directly derived, from a harvestable part of such a plant, such as dry pellets or powders, oil, fat and fatty acids, starch or proteins.

The present invention also encompasses use of nucleic acids encoding importin or yield related polypeptides as described herein and use of these importin or yield related polypeptides in enhancing any of the aforementioned yield-related traits in plants. For example, nucleic acids encoding importin or yield related polypeptide described herein, or the importin or yield related polypeptides themselves, may find use in breeding programmes in which a DNA marker is identified which may be genetically linked to an importin or yield related polypeptide-encoding gene. The nucleic acids/genes, or the importin or yield related polypeptides themselves may be used to define a molecular marker. This DNA or protein marker may then be used in breeding programmes to select plants having enhanced yield-related traits as defined hereinabove in the methods of the invention. Furthermore, allelic variants of an importin or yield related polypeptide-encoding nucleic acid/gene may find use in marker-assisted breeding programmes. Nucleic acids encoding importin or yield related polypeptides may also be used as probes for genetically and physically mapping the genes that they are a part of, and as markers for traits linked to those genes. Such information may be useful in plant breeding in order to develop lines with desired phenotypes.

DESCRIPTION OF FIGURES

The present invention will now be described with reference to the following figures in which.

ITEMS

Figure 1:
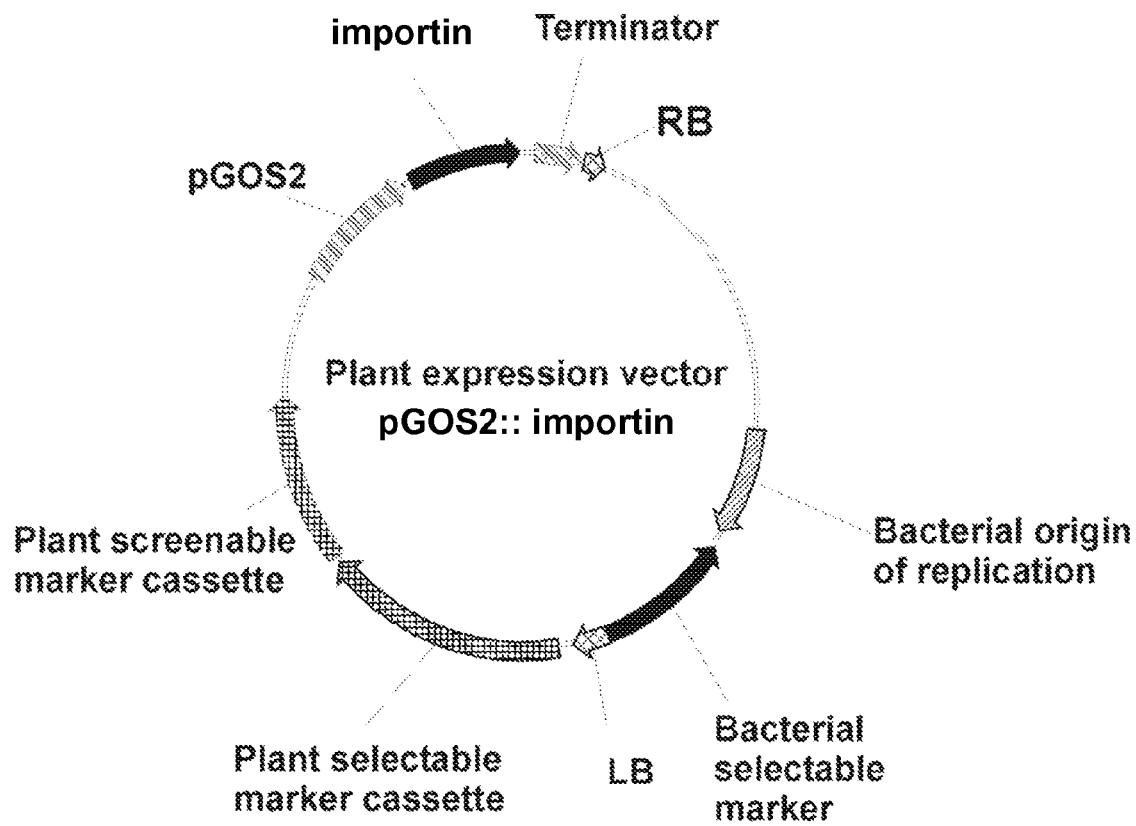
FIG. 1 represents the binary vector used for increased expression in *Oryza sativa* of an importin-encoding nucleic acid under the control of a rice GOS2 promoter (pGOS2).

The invention is in particular characterised by one or more of the following items.

1. A method for enhancing yield-related traits in plants relative to control plants, comprising modulating expression in a plant of a nucleic acid encoding an importin polypeptide comprising one or more of the following:
   (i) a polypeptide represented by SEQ ID NO: 2 or SEQ ID NO: 4 or a homologue thereof;
   (ii) a nucleic acid encoding a polypeptide represented by any one of SEQ ID NO: 2 or SEQ ID NO: 4;
   (iii) a nucleic acid represented by any one of SEQ ID NO: 1 or SEQ ID NO: 3 or a portion thereof or a sequence capable of hybridising thereto;
   (iv) a polypeptide sequence comprising a domain represented by one of the InterPro accession numbers described in Table 3 a or Table 4 a.

2. Method according to item 1, wherein said modulated expression is effected by introducing and expressing in a plant a nucleic acid encoding an importin polypeptide.

3. Method according to items 1 or 2, wherein said nucleic acid sequence encodes an orthologue or paralogue of any of the proteins given in Tables 3 a or 4 a.

4. Method according to any preceding item, wherein said enhanced yield-related traits comprises increased biomass and/or increased seed yield relative to control plants.

5. Method according to any one of items 2 to 4, wherein said nucleic acid is operably linked to a constitutive promoter, preferably to a GOS2 promoter, most preferably to a GOS2 promoter from rice.

6. Method according to any one of items 1 to 5, wherein said nucleic acid encoding an importin polypeptide is of plant origin, preferably from a dicotyledonous plant, more preferably from the family *Populus*, most preferably from *Populus trichocarpa*.

7. Plant or part thereof, including seeds, obtainable by a method according to any one of items 1 to 6, wherein said plant or part thereof comprises a recombinant nucleic acid encoding an importin polypeptide.

8. Construct comprising:
   (i) nucleic acid encoding an importin polypeptide as defined in items 1 or 3;
   (ii) one or more control sequences capable of driving expression of the nucleic acid sequence of (a); and optionally
   (iii) a transcription termination sequence.

9. Construct according to item 8, wherein one of said control sequences is a constitutive promoter, preferably a GOS2 promoter, most preferably a GOS2 promoter from rice.

10. Use of a construct according to item 8 or 9 in a method for making plants having increased yield, particularly increased biomass and/or increased seed yield relative to control plants.
11. Plant, plant part or plant cell transformed with a construct according to item 8 or 9.
12. Method for the production of a transgenic plant having increased yield, particularly increased biomass and/or increased seed yield relative to control plants, comprising:
    (i) introducing and expressing in a plant a nucleic acid encoding an importin polypeptide as defined in item 1 or 3; and
    (ii) cultivating the plant cell under conditions promoting plant growth and development.
13. Transgenic plant having increased yield, particularly increased biomass and/or increased seed yield, relative to control plants, resulting from modulated expression of a nucleic acid encoding an importin polypeptide as defined in item 1 or 3, or a transgenic plant cell derived from said transgenic plant.
14. Transgenic plant according to item 7, 11 or 13, or a transgenic plant cell derived thereof, wherein said plant is a crop plant, such as beet, or a monocot or a cereal, such as rice, maize, wheat, barley, millet, rye, triticale, *sorghum* emmer, spelt, *secale*, einkorn, teff, milo and oats.
15. Harvestable parts of a plant according to item 14, wherein said harvestable parts are preferably shoot biomass and/or seeds.
16. Products derived from a plant according to item 14 and/or from harvestable parts of a plant according to item 15.
17. Use of a nucleic acid encoding an importin polypeptide in increasing yield, particularly in increasing seed yield and/or shoot biomass in plants, relative to control plants.
18. A method for enhancing yield-related traits in plants relative to control plants, comprising modulating expression in a plant of a nucleic acid encoding a yield related polypeptide comprising one or more of the following:
    (i) a polypeptide represented by SEQ ID NO: 125, 127, 129, 131, 133 or 135 or a homologue thereof;
    (ii) a nucleic acid encoding a polypeptide represented by any one of SEQ ID NO: 125, 127, 129, 131, 133 or 135;
    (iii) a nucleic acid represented by any one of SEQ ID NO: 124, 126, 128, 130, 132, or 134 or a portion thereof or a sequence capable of hybridising thereto;
    (iv) a polypeptide sequence comprising a domain represented by one of the InterPro accession numbers described in any one of Tables 3 b, 4 b, 5, 6, 7, or 8.
19. Method according to item 18, wherein said modulated expression is effected by introducing and expressing in a plant a nucleic acid encoding a yield related polypeptide.
20. Method according to item 18 or 19, wherein said nucleic acid sequence encodes an orthologue or paralogue of any of the proteins given in Tables 3 b, 4 b, 5, 6, 7, or 8.
21. Method according to any one of items 18 to 20, wherein said enhanced yield-related traits comprises increased biomass and/or increased seed yield relative to control plants.
22. Method according to any one of items 19 to 21, wherein said nucleic acid is operably linked to a constitutive promoter, preferably to a GOS2 promoter, most preferably to a GOS2 promoter from rice.
23. Method according to any one of items 18 to 22, wherein said nucleic acid encoding a yield related polypeptide is of plant origin, preferably from a dicotyledonous plant or a monocotyledonous plant.
24. Plant or part thereof, including seeds, obtainable by a method according to any one of items 18 to 23, wherein said plant or part thereof comprises a recombinant nucleic acid encoding an yield related polypeptide.
25. Construct comprising:
    (i) nucleic acid encoding an yield related polypeptide as defined in items 18 or 20;
    (ii) one or more control sequences capable of driving expression of the nucleic acid sequence of (a); and optionally
    (iii) a transcription termination sequence.
26. Construct according to item 25, wherein one of said control sequences is a constitutive promoter, preferably a GOS2 promoter, most preferably a GOS2 promoter from rice.
27. Use of a construct according to item 25 or 26 in a method for making plants having increased yield, particularly increased biomass and/or increased seed yield relative to control plants.
28. Plant, plant part or plant cell transformed with a construct according to item 25 or 26.
29. Method for the production of a transgenic plant having increased yield, particularly increased biomass and/or increased seed yield relative to control plants, comprising:
    (i) introducing and expressing in a plant a nucleic acid encoding an yield related polypeptide as defined in item 18 or 20; and
    (ii) cultivating the plant cell under conditions promoting plant growth and development.
30. Transgenic plant having increased yield, particularly increased biomass and/or increased seed yield, relative to control plants, resulting from modulated expression of a nucleic acid encoding an yield related polypeptide as defined in item 18 or 20, or a transgenic plant cell derived from said transgenic plant.
31. Transgenic plant according to item 24, 28 or 30, or a transgenic plant cell derived thereof, wherein said plant is a crop plant, such as beet, or a monocot or a cereal, such as rice, maize, wheat, barley, millet, rye, triticale, *sorghum* emmer, spelt, *secale*, einkorn, teff, milo and oats.
32. Harvestable parts of a plant according to item 31, wherein said harvestable parts are preferably shoot biomass and/or seeds.
33. Products derived from a plant according to item 31 and/or from harvestable parts of a plant according to item 32.
34. Use of a nucleic acid encoding an yield related polypeptide in increasing yield, particularly in increasing seed yield and/or shoot biomass in plants, relative to control plants.

EXAMPLES

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R.D.D. Croy, published by BIOS Scientific Publications Ltd (UK) and Blackwell Scientific Publications (UK).

Example 1

Identification of Sequences Related to the Nucleic Acid Sequence Used in the Methods of Intervention 1.1 Importin Polypeptides Sequences (full length cDNA, ESTs or genomic) related to SEQ ID NO: 1, 2, 3 and 4 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid of SEQ ID NO: 1 was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search.

For example the E-value may be increased to show less stringent matches. This way, short nearly exact matches may be identified.

Table 3 a provides homologues of SEQ ID NO: 1 and 2 and Table 4 a provides homologues of SEQ ID NO: 3 and 4.

1.2 Yield Related Polypeptides

Sequences (full length cDNA, ESTs or genomic) related to SEQ ID NO: 124 to 135 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid of SEQ ID NO: 124 was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

Tables 3 b, 4 b, 5, 6, 7, and 8 provide homologues of SEQ ID NO: 124 to 135.

Sequences have been tentatively assembled and publicly disclosed by research institutions, such as The Institute for Genomic Research (TIGR; beginning with TA). The Eukaryotic Gene Orthologs (EGO) database is used to identify related sequences, either by keyword search or by using the BLAST algorithm with the nucleic acid sequence or polypeptide sequence of interest. Special nucleic acid sequence databases have been created for particular organisms, such as by the Joint Genome Institute.

Example 2

Alignment of Importin and Yield Related Polypeptide Sequences

Alignment of polypeptide sequences is performed using the ClustalW (1.83/2.0) algorithm of progressive alignment (Thompson et al. (1997) Nucleic Acids Res 25:4876-4882; Chenna et al. (2003). Nucleic Acids Res 31:3497-3500) with standard setting (slow alignment, similarity matrix: Gonnet (or Blosum 62 if polypeptides are aligned), gap opening penalty 10, gap extension penalty: 0.2). Minor manual editing is done to further optimise the alignment.

A phylogenetic tree of importin and yield related polypeptides is constructed using a neighbour-joining clustering algorithm as provided in the AlignX programme from the Vector NTI (Invitrogen).

Example 3

Calculation of Global Percentage Identity Between Polypeptide Sequences

Global percentages of similarity and identity between full length importin and yield related polypeptide sequences is determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix.

A MATGAT table for local alignment of a specific domain, or data on % identity/similarity between specific domains may also be produced.

Example 4

Identification of Domains Comprised in Importin and Yield Related Polypeptide Sequences The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

Tables 3 a, 3 b, 4 a, and 4 b provide the InterPro accession numbers of various importin and yield related polypeptides.

Example 5

Topology Prediction of the Importin and Yield Related Polypeptide Sequences

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site is also be predicted.

A number of parameters are selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

Example 6

Cloning of the Nucleic Acid Sequence Used in the Methods of the Invention 6.1 Importin Polypeptides The nucleic acid sequence is amplified by PCR using a *Populus trichocarpa* cDNA library (in pCMV Sport 6.0; Invitrogen, Paisley, UK). PCR is performed using Hifi Taq DNA polymerase in standard conditions, using 200 ng of template in a 50 μl PCR mix.

The primers used for SEQ ID NO: 1 are prm22596 (SEQ ID NO: 120; sense, start codon in bold): 5'-ggggacaagtttgta-caaaaaagcaggcttaaacaatgtctttgagaccaagcac-3' and prm22597 (SEQ ID NO: 121; reverse, complementary): 5'-ggggac-cactttgtacaagaaagctgggtgatccttcagc taaaagttgaatc-3', which include the AttB sites for Gateway recombination.

The primers used for SEQ ID NO: 3 are prm22367 (SEQ ID NO: 122; sense, start codon in bold): 5'-ggggacaagtttgta-caaaaaagcaggcttaaacaatggcaatggaagtgacc-3' and prm22368 (SEQ ID NO: 123; reverse, complementary): 5'-ggggac-cactttgtacaagaaagctgggtagcaataacc tcaaacagaaatgg-3', which include the AttB sites for Gateway recombination.

The amplified PCR fragment is purified also using standard methods. The first step of the Gateway procedure, the BP reaction, is then performed, during which the PCR fragment is recombined in vivo with the pDONR201 plasmid to produce, according to the Gateway terminology, an "entry clone", pimportin. Plasmid pDONR201 was purchased from Invitrogen, as part of the Gateway® technology.

The entry clone comprising SEQ ID NO: 1 or SEQ ID NO: 3 is then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 119) for constitutive specific expression is located upstream of this Gateway cassette.

After the LR recombination step, the resulting expression vector pGOS2::importin (FIG. 1) is transformed into *Agrobacterium* strain LBA4044 according to methods well known in the art.

2.2 Yield Related Polypeptides

The nucleic acid sequence was amplified by PCR using the relevant cDNA library (in pCMV Sport 6.0; Invitrogen, Paisley, UK). PCR was performed using Hifi Taq DNA polymerase in standard conditions, using 200 ng of template in a 50 μl PCR mix.

The primers used for SEQ ID NO: 124 were prm12025 (SEQ ID NO: 239; sense, start codon in bold): 5'-gggga-caagtttgtacaaaaaagcaggcttaaacaatgtacggtggtgatgaagtg-3' and prm12026 (SEQ ID NO: 240; reverse, complementary): 5'-ggggaccactttgtacaagaaagctggg tcttctgcacagctaccttcac-3', which include the AttB sites for Gateway recombination.

The primers used for SEQ ID NO: 126 were prm18466 (SEQ ID NO: 241; sense, start cod on in bold): 5'-gggga-caagtttgtacaaaaaagcaggcttaaacaatgggcaagaaagaacagc-3' and prm18467 (SEQ ID NO: 242; reverse, complementary): 5'-ggggaccactttgtacaagaaagctgggtc gatgtttaaaaccgttgaga-3', which include the AttB sites for Gateway recombination.

The primers used for SEQ ID NO: 128 were prm18499 (SEQ ID NO: 243; sense, start codon in bold): 5'-gggga-caagtttgtacaaaaaagcaggcttaaacaatgtcggtgtcgtcgc-3' and prm18500 (SEQ ID NO: 244; reverse, complementary): 5'-ggggaccactttgtacaagaaagctgggtgcctt ctagaactgaaattcg-3', which include the AttB sites for Gateway recombination.

The primers used for SEQ ID NO: 130 were prm17683 (SEQ ID NO: 245; sense, start codon in bold): 5'-gggga-caagtttgtacaaaaaagcaggcttaaacaatggaggcggcggtgatagac-3' and prm17684 (SEQ ID NO: 246; reverse, complementary): 5'-ggggaccactttgtacaagaaagctgggt aaacgggtcaaaagcatttccg-3', which include the AttB sites for Gateway recombination.

The primers used for SEQ ID NO: 132 were prm18464 (SEQ ID NO: 247; sense, start cod on in bold): 5'-gggga-caagtttgtacaaaaaagcaggcttaaacaatgatatcagcatttggagga-3' and prm18465 (SEQ ID NO: 248; reverse, complementary): 5'-ggggaccactttgtacaagaaagctg ggtctttgcactcgatttcatcat-3', which include the AttB sites for Gateway recombination.

The primers used for SEQ ID NO: 134 were prm17321 (SEQ ID NO: 249; sense, start cod on in bold): 5'-gggga-caagtttgtacaaaaaagcaggcttaaacaatggaatcagctgctgtgac-3' and prm17322 (SEQ ID NO: 250; reverse, complementary):

5'-ggggaccactttgtacaagaaagctgggt agagagaatttatgaggaacatga-3', which include the AttB sites for Gateway recombination.

The amplified PCR fragment was purified using standard methods. The first step of the Gateway procedure, the BP reaction, was then performed, during which the PCR fragment was recombined in vivo with the pDONR201 plasmid to produce, according to the Gateway terminology, an "entry clone", pYIELD-RELATED. Plasmid pDONR201 was purchased from Invitrogen, as part of the Gateway® technology.

The entry clone comprising SEQ ID NO: 124, 126, 128, 130, 132, or 134 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 238) for constitutive specific expression was located upstream of this Gateway cassette.

Figure 2:
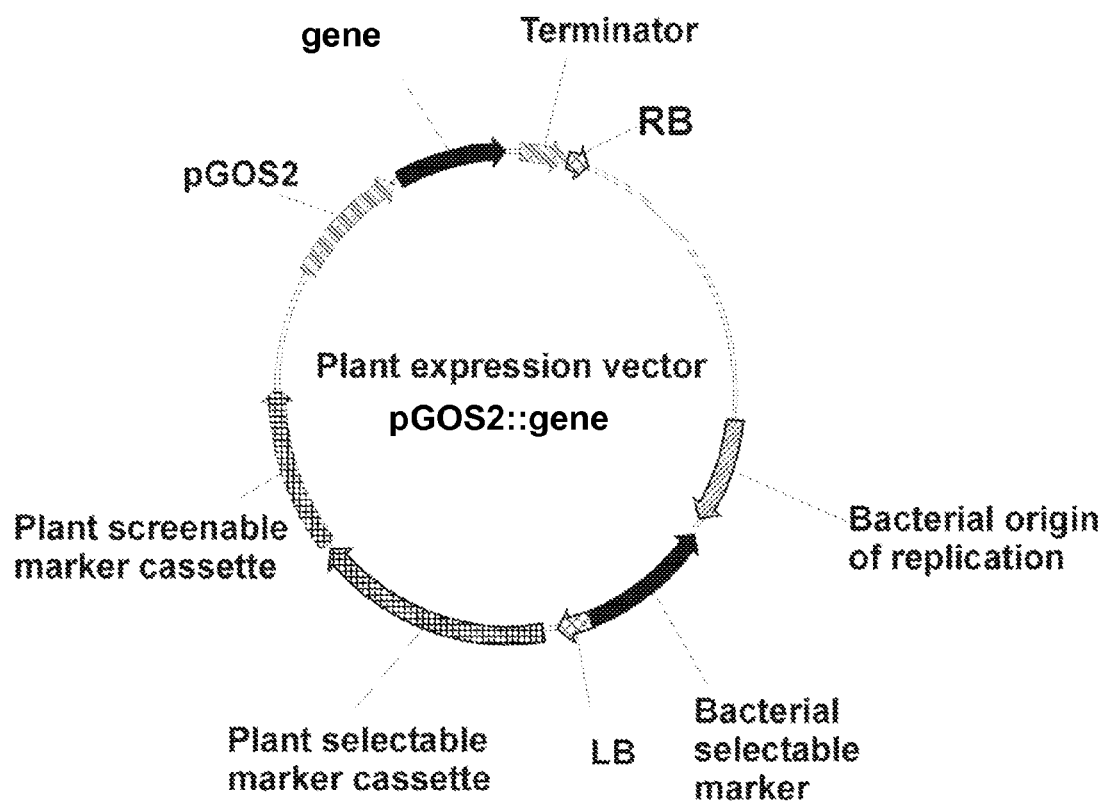
FIG. 2 represents the binary vector used for increased expression in *Oryza sativa* of a yield related-encoding nucleic acid under the control of a rice GOS2 promoter (pGOS2).

After the LR recombination step, the resulting expression vector pGOS2::yield related (FIG. 2) was transformed into *Agrobacterium* strain LBA4044 according to methods well known in the art.

Example 7

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands develop. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yield single locus transformants at a rate of over 50% (Aldemita and Hodges 1996, Chan et al. 1993, Hiei et al. 1994).

Example 8

Transformation of Other Crops

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agro-* bacterium tumefaciens containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7 Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 μm J Bot 65:654-659). Petiole explants are co-cultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 9

Phenotypic Evaluation Procedure 9.1 Evaluation Setup

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-bysize at random positions. Greenhouse conditions are of shorts days (12 hours light), 28° C. in the light and 22° C. in the dark, and a relative humidity of 70%. Plants grown under non-stress conditions were watered at regular intervals to ensure that water and nutrients were not limiting and to satisfy plant needs to complete growth and development.

Drought Screen

Plants from T2 seeds are grown in potting soil under normal conditions until they approached the heading stage. They are then transferred to a "dry" section where irrigation is withheld. Humidity probes are inserted in randomly chosen pots to monitor the soil water content (SWC). When SWC falls below certain thresholds, the plants are automatically re-watered continuously until a normal level is reached again. The plants are then re-transferred again to normal conditions. The rest of the cultivation (plant maturation, seed harvest) is the same as for plants not grown under abiotic stress conditions. Growth and yield parameters are recorded as detailed for growth under normal conditions.

Nitrogen Use Efficiency Screen

Rice plants from T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

9.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to determine whether there was an overall effect of the gene, also known as a global gene effect. The threshold for significance for a true global gene effect is set at a 5% probability level for the F test. A significant F test value points to a gene effect, meaning that it is not only the mere presence or position of the gene that is causing the differences in phenotype.

9.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area was the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and is converted to a physical surface value expressed in square mm by calibration.

Seed-Related Parameter Measurements

The mature primary panicles were harvested, counted, bagged, barcode-labelled and then dried for three days in an oven at 37° C. The panicles were then threshed and all the seeds are collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remain after the separation step. The total seed yield was measured by weighing all filled husks harvested from a plant. Total seed number per plant was measured by counting the number of husks harvested from a plant. Thousand Kernel Weight (TKW) was extrapolated from the number of filled seeds counted and their total weight. The Harvest Index (HI) in the present invention was defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 10

Results of Phenotypic Evaluation

TABLE 9

Results for rice plants transformed with SEQ ID NO: 124 under the control of a GOS2 promoter from rice and grown under non-stress conditions

| Parameter | Overall % difference |
| --- | --- |
| Total weight seeds | 19.3 |
| Number of filled seeds | 16.9 |
| Emergence Vigour | 14.2 |
| Root biomass | 5.2 |

For the parameters emergence vigor and root biomass, the percentage overall difference indicates $p<0.05$ and more than 5% difference compared to corresponding nullizygotes used as controls.

For the parameters total seed weight and number of filled seeds, the % difference is given for the 3 best events.

TABLE 10

Results for rice plants transformed with SEQ ID NO: 126 under the control of a GOS2 promoter from rice and grown under non-stress conditions

| Parameter | Overall % difference |
| --- | --- |
| Number first pan | 8.2 |

For the parameters shown in the table above, the percentage overall difference indicates $p<0.05$ and more than 5% difference compared to corresponding nullizygotes used as controls. In addition, an increase in total seed yield per plant relative to corresponding nullizygotes was also observed.

TABLE 11

Results for rice plants transformed with SEQ ID NO: 128 under the control of a GOS2 promoter from rice and grown under non-stress conditions

| Parameter | Overall % difference |
|---|---|
| Fill rate | 7.6 |
| Harvest index | 6.2 |

For the parameters shown in the table above, the percentage overall difference indicates $p<0.05$ and more than 5% difference compared to corresponding nullizygotes used as controls. In addition, an increase in total seed yield per plant and in the number of filled seeds was obtained relative to corresponding nullizygotes.

TABLE 12

Results for rice plants transformed with SEQ ID NO: 130 under the control of a GOS2 promoter from rice and grown under non-stress conditions

| Parameter | Overall % difference |
|---|---|
| Total weight seeds | 9.7 |
| Total number seeds | −6.7 |
| Fill rate | 18.6 |
| Harvest index | 8.6 |
| Number first panicles | −19.4 |
| Number filled seeds | 10.8 |
| Number flowers per panicle | 15.6 |
| Area Emergence | 12.8 |

For the parameters shown in the table above, the percentage overall difference indicates $p<0.05$ and more than 5% difference compared to corresponding nullizygotes used as controls.

TABLE 13

Results for rice plants transformed with SEQ ID NO: 132 under the control of a GOS2 promoter from rice and grown under non-stress conditions

| Parameter | Overall % identity |
|---|---|
| Total weight seeds | 8.7 |
| Fill rate | 12.7 |
| Harvest index | 6.3 |
| Number filled seeds | 12.6 |
| Number of flowers per panicle | 12.1 |

For the parameters shown in the table above, the percentage overall difference indicates $p<0.05$ and more than 5% difference compared to corresponding nullizygotes used as controls.

SEQUENCE LISTING (250 sequences)

SEQ ID NO: 1 - DNA, 1590 bp, Populus trichocarpa
atgtctttgagaccaagcacgagaaccgatgttcgccggaaccgatacaaagtcgccgtcgacgccgatgaaggtaggcggagaagagaggacaatatggttgagatccgaaagaacaagcgtgaagagagtttacaaaagaagcgacgcgaaggtctcctggcacaacagttccctgccgctgatctctcttcttctaatatggaaaagaagttagagagtttgccttcgatggtgtctggtgtttggtctgatgatagtaatttgcagctggaagcaactactcagtttcgaaaactactttccattgagaggagccctcccatagaggaagttatacaggctggggttgttccaagatttgtcgagcttcttgttagggaggatttccctcagcttcagtttgaggctgcttgggctctcacaaatattgcctctggaacttcagagaacacaaaggtggtaattgatcatggtgcagttccgatatttgtcaagcttctaggttctcccagtgatgatgttagggagcaggctgtgtgggcattgggaaatgttgctggtgactcccctaagtgccgtgatcttgtgctcagccatggagcgttgattcctctcctggcacagttgaatgagcacgcaaagctttcagtgctgaggaatgctacatggacactgtcaaacttctgcaggggcaagccacagcctctgtttgagaaggtgagaccagcccttcctgcacttgaacgtcttgttcattcaactgatgaagaagtcctaactgatgcttgttgggcactctcttatctttctgatggtacaaatgacaaaatccaagctgttattgaggcaggggtctgtcctcgacttgtggagctcctcctccatccttctccttcagtgcttgttcccgcccttcgtacagttggaaatattgtgactggggatgatatgcagacccagtgcataattaatactggtgcacttccatgcctcctaagcctgttgactcataaccataaaaagagcatcaagaaagaagcttgctggactatctcaaacattaccgcaggaaacaaggaacagattcaggcagttattgaggctggtttaattggcccgcttgttaatttacttcaaaatgcggagtttgacataaagaaagaagccgcttgggcagtttctaatgctacttctggtggtactcatgagcaaattaagtttttggtcagtcagggatgtattaaaccattgtgtgatcttcttgtatgccctgatccgaggattgtaacagtatgtctagaaggattagagaatattctgaaggttggggaagttgaaaagaatttggggaacagtggagatgttaatttctatgcccagatgatagatgatgctgagggactagaaaagattgaaaatctacagagtcatgacaacaatgagatctatgagaaggcagtcaagattctcgagacgtattggttggaagaagatgatgaggctttgccttcaggtgatggtgcccagcaaggatttcactttggtgagaacaatgttcaagttccatctggtggattcaacttttag

SEQ ID NO: 2 - protein, 529 aa, Populus trichocarpa
MSLRPSTRTDVRRNRYKVAVDADEGRRRREDNMVEIRKNKREESLQKKRREGLLAQQFPAADLSSSNMEKKLESLPSMVSGVWSDDSNLQLEATTQFRKLLSIERSPPIEEVIQAGVVPRFVELLVREDFPQLQFEAAWALTNIASGTSENTKVVIDHGAVPIFVKLLGSPSDDVREQAVWALGNVAGDSPKCRDLVLSHGALIPLLAQLNEHAKLSVLRNATWTLSNFCRGKPQPLFEKVRPALPALERLVHSTDEEVLTDACWALSYLSDGTNDKIQAVIEAGVCPRLVELLLHPSPSVLVPALRTVGNIVTGDDMQTQCIINTGALPCLLSLLTHNHKKSIKKEACWTISNITAGNKEQIQAVIEAGLIGPLVNLLQNAEFDIKKEAAWAVSNATSGGTHEQIKFLVSQGCIKPLCDLLVCPDPRIVTVCLEGLENILKVGEVEKNLGNSGDVNFYAQMIDDAEGLEKIENLQSHDNNEIYEKAVKILETYWLEEDDEALPSGDGAQQGFHFGENNVQVPSGGFNF

SEQ ID NO: 3 - DNA, 2616 bp, Populus trichocarpa
atggcaatggaagtgacccaggtgcttttgaatgcccaatctatagatgggaatgtgcggaagcatgcagaagaaagcttaaaacagtttcaggagcaaaacctgcccagttttttgctctctctctccggagagctagctaatgatgagaaacctgttgacagtcgtaaattagcaggtttaattcttaaaaatgcgttggatgcaaaggaacagcatagaaagcttgagcttgttcaaagatggttgtcgctggacaacaatgcaaagggtcaaattaaggcatgtttgttgaagacacttgcttctcctgtaccagatgcacggtcaactgcatctcaagttattgccaagattgcagggattgagttgcctcagagacagtggccagagctgattggatcacttttatccaatattcatcagttacctgctcatgtcaagcaagctactttagagactcttggatatttgtgtgaggaagtctcacctgatgttgtagatcaagaccatgtaaacaagatacttacagcagtagtacagggcatgaacgcaactgaaggaaacaatgatgttaggcttgctgcaacccgagcactgtacaatgcacttggatttgctcaggcaaacttcagcaatgatatggagcgtgattatatcatgagagtggcctgcgaggcaactttatccccagaaatgaagataagacaagctgcttatgagtgtctggtctctatttcatcaacatactatgagaaattggctccttatatgcaggatatctttaacatcacggcgaaggccgtgagggaagatgaagaacctgtagcccttcaagcaattgaattctggagttcaatatgtgatgaggagatagatatcttggaagaatatgggggtgatttcactggggattctgatgttccttgcttttactttattaagcaggctctccctgctttggtcccaatgttgttggagactctcctaaagcaagaggaggatcaggatcaagatgaaggagcttggaatattgcaatggctggtggaacatgccttggtttggttgcaaggactgtgggagatgatattgtgcagcttgttatgcaattcattgaagataacattacaaaaccagattggaggcatagagaggcagctacttatgcatttggctcgatcttggaaggtccttcccctgagaaactaacacctcttgttaatgttgctttgaacttcatgctgactgctttgacaaaggatccaaataaccatgtgaaggatacaactgcttggacccttggtcgaatctttgaattcctccatggttcaactgtggatacaccgataattactcaagcaaattgccaacaaattgtcacggtactactccagagcatgaaggacgttgccaatgtagcagagaaggcatgtggtgccctctatttccttgcccagggttatgaagaggtgaccccatcatcacctcttactccttacttccaggaaattgtccagacacttctctttgttacccacagagaggatgctggggagtcccgattaaggactgctgcatatgaaacgttgaatgaggtggtgagatactcgactgatgaaacagcaccaatggtgctgcaactggttcctgtcatcatgacggagcttcacaatactcttgaagggcagaagctttcttctgatgagagagagaagcagggtgaattgcaagggcttctctgtggttgcttacaggtcataattcagaagttaggctcctctgagccaactaagtatgtgttcatgcaatatgtagatcagattatggggctcttcctgagggtctttgcttgtagaagtgcaactgtgcatgaggaggccatgttagccataggagcccttgcctatgcaactggtcctgattttgcaaaatacatgccagagttttacaagtacctagaaatgggccttcagaattttgaggagtaccaagtctgtgctgtgactgtcggtgtggtgggtgatatctgcagggcattggaagataaaattttgccttactgtgatggtattatgactcagcttctcaaggatttatcaagcaaccagctgcatagatctgtgaagcctcctattttctctagctttggcgacattgccctggcaataggagagaattttgagaagtacttgatgtatgccatgccaatgctgcaaagtgccgcagagttgtctgcccacacatctgttgctgacgatgaaatgactgaatacacaaattctttgagaaatggaattttggaggcatactctggaattcttcaagggtttaagaattctcctaaaactcagctcttgattccttatgcacctcacatcctgcagttcttggatagcatgtacatggagaaagacatggatgatgtcgttatgaaaactgcaattggagtcctgggagatttagcagatacactgggaagtaatgctggctctttgatacagcaatctctttctagcaaagactttttaaatgaatgtttgtcttctgatgaccatatgattaaggaatctgctgaatgggccaagttggccatcagtcgtgccatttctgtttga

SEQ ID NO: 4 - protein, 871 aa, Populus trichocarpa
MAMEVTQVLLNAQSIDGNVRKHAEESLKQFQEQNLPSFLLSLSGELANDEKPVDSRKLAGLILKNALDAKEQHRKLELVQRWLSLDNNAKGQIKACLLKTLASPVPDARSTASQVIAKIAGIELPQRQWPELIGSLLSNIHQLPAHVKQATLETLGYLCEEVSPDVVDQDHVNKILTAVVQGMNATEGNNDVRLAATRALYNALGFAQANFSNDMERDYIMRVACEATLSPEMKIRQAAYECLVSISSTYYEKLAPYMQDIFNITAKAVREDEEPVALQAIEFWSSICDEEIDILEEYGGDFTGDSDVPCFYFIKQALPALVPMLLETLLKQEEDQDQDEGAWNIAMAGGTCLGLVARTVGDDIVQLVMQFIEDNITKPDWRHREAATYAFGSILEGPSPEKLTPLVNVALNFMLTALTKDPNNHVKDTTAWTLGRIFEFLHGSTVDTPIITQANCQQIVTVLLQSMKDVANVAEKACGALYFLAQGYEEVTPSSPLTPYFQEIVQTLLFVTHREDAGESRLRTAAYETLNEVVRYSTDETAPMVLQLVPVIMTELHNTLEGQKLSSDEREKQGELQGLLCGCLQVIIQKLGSSEPTKYVFMQYVDQIMGLFLRVFACRSATVHEEAMLAIGALAYATGPDFAKYMPEFYKYLEMGLQNFEEYQVCAVTVGVVGDICRALEDKILPYCDGIMTQLLKDLSSNQLHRSVKPPIFSSFGDIALAIGENFEKYLMYAMPMLQSAAELSAHTSVADDEMTEYTNSLRNGILEAYSGILQGFKNSPKTQLLIPYAPHILQFLDSMYMEKDMDDVVMKTAIGVLGDLADTLGSNAGSLIQQSLSSKDFLNECLSSDDHMIKESAEWAKLAISRAISV

SEQ ID NO: 5 - DNA, 2062 bp, Arabidopsis thaliana
agcaccagacgactcgtcctccacgatcccaatttctccaatttcaattttgccaaagagcgagagagaaggaagaagatccagacgaagtggtttgccttcagggaacgagagagagaaagagattttaacaaacgatgtcgctgaggccgagcacacgcgcggagctaaggaagaagatatacaagacaggcgtcgatgccgatgaggccaggcggaggagagaggacaatctcgtcgagattaggaaaaacaagcgtgaggatagtcttctcaagaagcgtcgtgaaggaatgatgcttcagcagcagctgcctctcggagctggccttgatggtccccagaccgctgccgccgttgagaaacgattagaaggtatcccaatgatggtacaaggtgtttattctgatgatcctcaagctcagctagaagcgactacccaatttagaaagttgttatctatagagcgtagtcctccaattgatgaagtgatcaaagctggggttatccctcgatttgtggagtttcttggaaggcatgaccatcctcaattgcagtttgaggctgcatgggctttgaccaatgttgcgtcaggaacatcagatcatactcgggttgtaatcgaacagggggcggttcctatcttcgttaagcttcttacatctgctagtgatgacgttcgagagcaggcggtgtgggccttgggaaatgttgctggggactctccaaactgcaggaatcttgttctcaactatggggcccttgagccattgctggctcagttaaatgaaaattctaagttgtccatgctaagaaatgctacatggaccttgtccaacttttgtcgtggtaaaccaccaacaccatttgaacaggtgaagcctgcgttgccaattcttcggcagcttatctatctgaatgatgaagaggttctcactgatgcttgctgggctctctcctacctttcagatggccccaatgataagattcaggctgtgattgaggcaggtgtctgtccacgacttgtggagcttttgggtcatcaatcacctacggttctcattcctgctcttcgaactgttgggaacatcgtaactggtgatgactctcagacacagtttataattgagagtggcgtactaccacacctttataatttgctgacgcaaaatcacaagaaaagtataaaaaaagaagcttgttggactatctcgaatattactgctgggaataaacttcagatagaggctgtggttggcgctggaataatcctccctcttgtgcacttgctccaaaacgcggagttcgatataaagaaggaagctgcttgggctatttccaatgccacatcaggagggtcacatgagcagattcaatatttggtgacccaaggctgcatcaaaccactttgtgatcttctaatctgccctgatccaaggatcgtgacagtgtgcctcgagggtcttgaaaacattctcaaggttggtgaggctgacaaggaaatgggattaaacagtggggtgaatctctatgctcaaataatagaagaatctgatgggttggacaaagtcgaaaaccttcaatcccatgataacaacgagatatatgagaaggccgttaagatattggagagatattgggctgaagaagaggaagaacagattctgcaggacggcgggaatgacaattcacaacaggctttcaattttgggaacaatcccgctgctcccgttggtggattcaaatttgcctgaaaaaggttcaagttcgactttttgagttctggtgcaaaaaggcttatttttctgtttttttttctttttgttgttgatgttgtccttatttgtctgaatcattctctgattctgtatcttaaactctgctatgaattatgtgtagtgtggtttctggtttaggatatggtacactttgtatttgtcactttaatctttgtcgtcgttatagtttaataacttttacttggcaagagtacaagtacaagaaatatttgattgcaaaagagtcttcttgtcttgttaataaagtcctcaaatgaattggt

SEQ ID NO: 6 - protein, 538 aa, Arabidopsis thaliana
MSLRPSTRAELRKKIYKTGVDADEARRRREDNLVEIRKNKREDSLLKKRREGMMLQQQLPLGAGLDGPQTAAAVEKRLEGIPMMVQGVYSDDPQAQLEATTQFRKLLSIERSPPIDEVIKAGVIPRFVEFLGRHDHPQLQFEAAWALTNVASGTSDHTRVVIEQGAVPIFVKLLTSASDDVREQAVWALGNVAGDSPNCRNLVLNYGALEPLLAQLNENSKLSMLRNATWTLSNFCRGKPPTPFEQVKPALPILRQLIYLNDEEVLTDACWALSYLSDGPNDKIQAVIEAGVCPRLVELLGHQSPTVLIPALRTVGNIVTGDDSQTQFIIESGVLPHLYNLLTQNHKKSIKKEACWTISNITAGNKLQIEAVVGAGIILPLVHLLQNAEFDIKKEAAWAISNATSGGSHEQIQYLVTQGCIKPLCDLLICPDPRIVTVCLEGLENILKVGEADKEMGLNSGVNLYAQIIEESDGLDKVENLQSHDNNEIYEKAVKILERYWAEEEEEQILQDGGNDNSQQAFNFGNNPAAPVGGFKFA

SEQ ID NO: 7 - DNA, 2330 bp, Arabidopsis thaliana
gctttcattctttggatgcgctgttgtcaacttgtccctcgctgcctctgcttcttaactctttctttatcacttttccactcccaaatcaatttttaggttttttttataattataatttatttgctctcggcaggatctatataatacacagaccagtctttgcgtgtgcttgtgtgcattcattgatcgggtttatatcttttcatcggattttctttgtcgagcaagagccatgtcactgagacccaacgctaagacggaggttcgccggaaccgatacaaagttgcagtggatgcggaggaaggacgacggaggagagaagacaacatggttgagatccgtaaaagcaagcgtgaggagagtttgatgaagaagagacgtgaaggtatgcaagctcttcagggtttcccttcagcttccgccgcctccgtcgataagaagttggatagtctgaaggatatggtcgctggggtttggtccgatgaccctgccttgcagcttgagtccactactcagttcaggaagcttctctctattgagagaagtcctccaatcgaggaagtgataagtgctggtgttgttcctaggtttgttgagtttcttaagaaagaagattaccccgccattcagtttgaggcagcttgggctctaacaaacattgcatctggaacatcggatcacactaaggttgtaatcgatcacaatgctgttccaatctttgttcagcttcttgcttcccctagcgatgatgttcgtgaacaggctgtatgggctttgggtaacgttgctggtgattcaccacggtgccgtgatcttgttcttggatgtggggcactgcttccgctgctcaatcagcttaatgagcatgctaaattgtccatgcttcgaaatgccacttggaccttgtcaaacttctgtcgtggcaagcctcagcctcactttgaccaggtcaaacctgctcttcccgcccttgaacgactaattcattcagatgatgaagaagtcttgacagatgcctgttgggctctttcttacctctctgatgggaccaatgacaaaatccagactgtcatccaggccggtgttgtcccaaaacttgttgaacttctcctccatcattctccatctgtgctaattcctgctcttcgcactgttggaaatatagttactggagatgatatacaaacacagtgcgtgatcaatagtggtgctctaccttgtcttgccaacctgctcactcaaaaccataagaaaagcataaagaaggaagcttgctggacgatttcaaacatcacagcaggcaacaaagatcagatccagacggtagttgaggctaatttgatttccccgttggtgagtctgcttcaaaatgctgaatttgacattaagaaggaagctgcatgggcaatttcaaatgcaacttcaggtggttctcatgatcaaataaaatacctggtggagcaagggtgcataaaaccattatgcgatctcctggtttgcccagatccaagaatcataactgtctgccttgaaggattggaaaacattttgaaggtgggagaggcagagaagaacttgggtcacacaggagacatgaactattacgctcagctgattgatgatgcagaagggctagaaaagatcgagaaccttcagagccatgacaacaatgagatctatgagaaggctgttaaaattctggagacatactggcttgaagaggaagatgatgagacacagcaacctccaggtgttgatggttctcaggctgggttccagtttggagggaatcaagctccagtaccatccggaggattcaacttcagctgaaggtaaataaaagaatggaattggaagcttgcaacttgagaatggtgaaaggtcagagtcagtcagagtctagtttcactgccatggttatactccaggtctggtctggtctggtctcagaggtttgtaccgggtggtcggtttaaaagtacagcgtctgagaaagtgtttggttcattgtccagggctatttttttgaaatgactggtacaccggtcgtgagtcgacctttgtgttgtttttaaattttggagggttataaaaacttacagtggagtcttttgtttttgtgttgacaacagtttgtatgtcggttaaaaaattgaaaccataaaccctttattggtcttaatatgtttggtgtctgatttcctaaggaaaggtttttttttttttggtcaaacctaaggaagggtttatcttcgagttataaagactcgaatctttatttgaattatgaagtaaagtatacataaaacagcaataaattattatg

SEQ ID NO: 8 - protein, 532 aa, Arabidopsis thaliana
MSLRPNAKTEVRRNRYKVAVDAEEGRRRREDNMVEIRKSKREESLMKKRREGMQALQGFPSASAASVDKKLDSLKDMVAGVWSDDPALQLESTTQFRKLLSIERSPPIEEVISAGVVPRFVEFLKKEDYPAIQFEAAWALTNIASGTSDHTKVVIDHNAVPIFVQLLASPSDDVREQAVWALGNVAGDSPRCRDLVLGCGALLPLLNQLNEHAKLSMLRNATWTLSNFCRGKPQPHFDQVKPALPALERLIHSDDEEVLTDACWALSYLSDGTNDKIQTVIQAGVVPKLVELLLHHSPSVLIPALRTVGNIVTGDDIQTQCVINSGALPCLANLLTQNHKKSIKKEACWTISNITAGNKDQIQTVVEANLISPLVSLLQNAEFDIKKEAAWAISNATSGGSHDQIKYLVEQGCIKPLCDLLVCPDPRIITVCLEGLENILKVGEAEKNLGHTGDMNYYAQLIDDAEGLEKIENLQSHDNNEIYEKAVKILETYWLEEEDDETQQPPGVDGSQAGFQFGGNQAPVPSGGFNFS

SEQ ID NO: 9 - DNA, 2338 bp, Arabidopsis thaliana
ccaaaatgtttttgtaaaccaacgaaattcaatctttctctctgtgccttttttcctcttttctcgttcccctctacttcatttagggtttatcatcctctaccaatccgccgattctatacatacacttttcatatatatacatacatcgtctccactctcgttggctcatttttcattcaccgccacgaagcaagaggagattcgtattagccaccatgtctttgagacctaacgctaagactgaggttcgccggaaccgctacaaagtggcggtggatgctgaggaaggaagacggaggagagaggacaacatggtcgagatccgtaagagtaagcgtgaagaaagcttacagaagaagcgtcgtgaaggccttcaagctaatcagctacctcaattcgctccttctcctgttcctgcttcatcaactgttgagaagaagttggagagtttgcctgctatggttggtggtgtttggtcagatgatagaagtttacagcttgaagcgactactcagttccggaaattgctttctattgagcgtagtcctccgattgaagaagtgattgatgctggtgttgtgcctcggtttgtggaatttctcactagagaggattatccacagcttcagtttgaggctgcttgggcattgacaaacattgcttctgggacttcagagaatacaaaggtggtcattgaacatggtgctgttccgatttttgttcaactattggcttctcagagtgatgatgtccgtgagcaggctgtgtgggcattagggaatgttgctggtgattctccacggtgcagagatcttgtccttggtcaaggagctttgataccattactctctcagttgaatgagcatgctaaactctcgatgctgagaaatgctacttggaccctctctaatttctgcaggggcaagccacagcctccctttgaccaggtccgtccagcactcccagcccttgaacgcctgattcattcgactgatgaggaagtgttaacggatgcatgttgggctctctcttacctttccgatggcacaaatgacaaaatccaatctgtcattgaggcaggtgttgttcctcgactcgtcgagcttctccagcatcaatcaccatctgtgcttattcctgcccttcgtagtattggtaacattgtcactggagatgatctgcagacacagtgtgtaattagtcatggtgcacttcttagccttttgagccttctgactcacaatcataagaagagcatcaaaaaggaagcttgctggacaatctcaaatatcactgctggaaacagggaccagattcaggctgtgtgtgaagctggtttgatttgccctcttgtcaatctgcttcaaaatgcggagtttgatataaagaaagaagctgcgtgggcaatatcaaatgccacttcaggtggttctcctgaccaaatcaagtacatggtggaacagggagtcgtgaaaccactgtgtgatcttttggtgtgccctgatccaaggattatcactgtgtgtctggaaggattggagaacattttgaaagttggggaagctgaaaaggtcacaggaaataccggggatgtaaacttttatgcacagctgatcgatgatgctgagggattagaaaagattgagaatctgcagagtcatgacaacagcgaaatctatgagaaggcagtgaagattcttgaaacgtactggttggaagaggaagatgaaactttaccacctggtgatccctctgcacaaggcttccagtttggaggaggtaatgatgcagccgtaccaccaggtggattcaacttccagtgaaggtaaaaaaacctcactacttgggactaatttatctaagcatctaaggctagactagcaaacagagtaaatctgcctgtgtgtctaccttgtgtgaatctgtgagtctggttttgcttccacaggagctgaacatgacgatttgaagagtcgaaggagcttaaagagtttgggggcactggttaaaaagggtatgattagagagtctggtcttctgtgtaaaagtcagatggggtgccttacttagtctggcctggtccggtcagatccagtggttggtgggtttgagtcatggaataagcttgttgggggggagttgggtaggagtcatcaagggatatttatttttgggaaagggtttataagtttttaaagtgtgatctgatgagaatgtgtctctctgggtttttgttacatttgtactacacaacactgcaaagtcaaacataaaaaagttggtcaaactttatttggtcttattggtgacataaaagcccaattggttcgtctct

SEQ ID NO: 10 - protein, 535 aa, Arabidopsis thaliana
MSLRPNAKTEVRRNRYKVAVDAEEGRRRREDNMVEIRKSKREESLQKKRREGLQANQLPQFAPSPVPASSTVEKKLESLPAMVGGVWSDDRSLQLEATTQFRKLLSIERSPPIEEVIDAGVVPRFVEFLTREDYPQLQFEAAWALTNIASGTSENTKVVIEHGAVPIFVQLLASQSDDVREQAVWALGNVAGDSPRCRDLVLGQGALIPLLSQLNEHAKLSMLRNATWTLSNFCRGKPQPPFDQVRPALPALERLIHSTDEEVLTDACWALSYLSDGTNDKIQSVIEAGVVPRLVELLQHQSPSVLIPALRSIGNIVTGDDLQTQCVISHGALLSLLSLLTHNHKKSIKKEACWTISNITAGNRDQIQAVCEAGLICPLVNLLQNAEFDIKKEAAWAISNATSGGSPDQIKYMVEQGVVKPLCDLLVCPDPRIITVCLEGLENILKVGEAEKVTGNTGDVNFYAQLIDDAEGLEKIENLQSHDNSEIYEKAVKILETYWLEEEDETLPPGDPSAQGFQFGGGNDAAVPPGGFNFQ

SEQ ID NO: 11 - DNA, 3811 bp, Arabidopsis thaliana
gctggaactgatttttttcttctctctctctctctctcttccttctgggcttctagggtttgtcctctccagtccccgatttccgctttatccgatcggccgccgccgagattctagataaacctatggcaatggaggttacgcagttgctcattaatgctcagtcgattgatggaactgtacgtaagcacgcggaagaaagtcttaagcagtttcaggagcaaaaccttgcgggtttcttgttgtcgcttgctggagagcttgcgaatgatgagaagccagtagatagcaggaaattagctggtttagtccttaaaaatgctcttgatgctaaggaacaacacaggaagtatgagcttgttcagagatggttggctctagacatgtcaacaaagtcgcagatcagagctttcttgttgaagacactgtcggcacctgtgcctgatgttcgttcgactgcatctcaggtcattgctaaggttgcaggtattgagttaccacagaagcagtggcctgagctcatagtgtctcttctctcaaatattcaccagttacctgctcatgtcaagcaagccactttggagactcttggatacctatgtgaagaagtgtcacctgatgttgttgaacaggagcatgtaaataagatactcacagctgttgttcagggtatgaatgctgctgaaggtaatactgatgttagacttgctgcaacccgtgctttatacatggctctcggattcgcccaagcaaatttcaacaacgacatggagcgtgattatatcatgagagttgtgtgtgaagcaaccctgtcccctgaggtgaaaattaggcaggcagcttttgagtgtttggtatctatcgcttccacatactatgagaagttggcgcattacatgcaagatatattcaacatcacagctaaggctgtaagagaagatgacgagtctgttgctctacaggcaattgagttctggagttctatttgtgacgaagagattgacatcttagaagaatatggtggtgagttcgctggggattctgatgttccatgcttttattttactaagcaggctctccctggtcttgtgcctctactgctggagactcttctgaagcaagaagaagatcaagatttggatgaaggggcttggaatattgcaatggcaggtgggacatgcctcggtttggttgctagggcagttggagatgacattgttccacatgtcatgccgtttattgaagagaaaatatcaaagcctgattggagagagcgagaagctgcaacttatgcttttggttccattttggaaggcccttctgccgataagttgatggcaattgttaacgcagcgttaacatttatgctcaatgctctaacaaatgacccaagcaaccatgtgaaagacacaaccgcatggacccttggtcggatatttgagttccttcatggttcaacaatcgagacacctattattaatcaggcaaactgccagcagataatcacagtactcatccagagcatgaatgatgcgcctaatgttgccgagaaggcttgtggggctctgtacttccttgctcaaggctatgaggatatcggtcccagttctccgttaacacccttcttccaggaaattattaagtcacttttagctgttgcacacagagaggatgcaactgaatcacgcttgcggactgcagcatatgaggcattgaatgaagttgtcaggtgttcaactgatgaaacgtctaccatggttctgcaattagtaccagtgataatgatggagcttcacaatactttggaaggggaaaagctttcattggatgagagggagaaacaaaacgagttgcagggacttctatgtggatgcttgcaggtcatcatacagaaattaggatctgaaccaaccaagtctaagttcatggagtatgcagaccaaatgatgggacttttcctgagggtgtttggttgtagaagtgcaactgcacatgaggaagccatgcttgccattggtgctcttgcttatgcagcaggtcccaattttgccaaatacatgcctgagttttataagtacttggagatgggtcttcaaaactttgaagaataccaagtgtgtgctgttactgttggtgttgttggggatgtctgcagagcattggaggacaagattttaccttattgcgatgggattatgacacagcttctgaaagatttgtcgagcaaccaattgcaccgatcagtgaagccaccgatattctcctgttttggtgacatagcacttgctatcggtgaggattttgataagtactggaggtattcaatgccgatgcttcagagtgccgcagagttatctgctcactcggctggagctgatgatgaaatgacggagtacacaaactcattgagaaacggaatccttgaggcttattcaggcatatttcaaggtttcaagaactccgccaaaacccagctcctgattcctttcgcaccccatatcctccagtttttggacagtatatacatggagaaagacatggacgaggtggtgatgaagacagcgattggggtcttaggagatttagcagatacactagggagtcatgtgggtggtttgatacaacagtcagtgtcaagtaaagagttcttaaacgaatgtttgtcttctgaagaccacacaattaaagaagcagccgaatgggcgaagcatgccataacccgtgccatatctgtttgaaggctcttcttttgcctataagaaagaaaattccttttgctttttagtaaagtctgcatgcatctctgggtgggttgagtcggtcggggggaggggtagagctgcaacatccgagtcacatcagcatcatcagcatcagtttcatttgcatcatcagcataactggggtcagtcagggaatcgttgagtcgtggatgtggggaatgatgagttttggggtaaataatgaaactggaagagtcacgggtgaaagtttcccgggtaaggttaaatccccgggagtagaaagaggaggaagtgagtcatggtcgttttctggtgggttttgggacaaagttataccaaaaaaaaaaaggtttcatggaacatctcataatacattcttgttttttcttttctctcatatgttcttcaaccccttgaggagggagaggtctcaggtttttatcaagtgggggcattattagaggacaatcccttgattttttcttttgttttcttttattatttggttagttgcagtctttgcatcatcattttgtcttttgggggggtttgtatgtttgattaaaagcattattcacatttttatttttatataaagaagtttcacatgtctgtctatcttctctttgctatgatgcagtttagggggttttgcatatatacttgtgttttgtttgcaatcaagtttcaaatgtcacatacaggaacatttttattatatggtgtcatgtcttagggtcttaaagaggtccacatctattcattttactatggaactgtttacaatcgtttagaatccattatttgatttggctcgaactatatgggaaagggcacatgttaataggagaaaacgtcctgccttactctgcttccaaagagtcaagttaagagatcgaagaacatttcacattcacgctgtttatggaaacctcaattttgattgtatgtgttgcttttttttggttttccaaacgccaaatgcaactgataccgaacctatattttgaaaaatgttttcatgtgtatttgaaacattctagaccattcaagttatggtttaaatt

SEQ ID NO: 12 - protein, 870 aa, Arabidopsis thaliana
MAMEVTQLLINAQSIDGTVRKHAEESLKQFQEQNLAGFLLSLAGELANDEKPVDSRKLAGLVLKNALDAKEQHRKYELVQRWLALDMSTKSQIRAFLLKTLSAPVPDVRSTASQVIAKVAGIELPQKQWPELIVSLLSNIHQLPAHVKQATLETLGYLCEEVSPDVVEQEHVNKILTAVVQGMNAAEGNTDVRLAATRALYMALGFAQANFNNDMERDYIMRVVCEATLSPEVKIRQAAFECLVSIASTYYEKLAHYMQDIFNITAKAVREDDESVALQAIEFWSSICDEEIDILEEYGGEFAGDSDVPCFYFTKQALPGLVPLLLETLLKQEEDQDLDEGAWNIAMAGGTCLGLVARAVGDDIVPHVMPFIEEKISKPDWREREAATYAFGSILEGPSADKLMAIVNAALTFMLNALTNDPSNHVKDTTAWTLGRIFEFLHGSTIETPIINQANCQQIITVLIQSMNDAPNVAEKACGALYFLAQGYEDIGPSSPLTPFFQEIIKSLLAVAHREDATESRLRTAAYEALNEVVRCSTDETSTMVLQLVPVIMMELHNTLEGEKLSLDEREKQNELQGLLCGCLQVIIQKLGSEPTKSKFMEYADQMMGLFLRVFGCRSATAHEEAMLAIGALAYAAGPNFAKYMPEFYKYLEMGLQNFEEYQVCAVTVGVVGDVCRALEDKILPYCDGIMTQLLKDLSSNQLHRSVKPPIFSCFGDIALAIGEDFDKYWRYSMPMLQSAAELSAHSAGADDEMTEYTNSLRNGILEAYSGIFQGFKNSAKTQLLIPFAPHILQFLDSIYMEKDMDEVVMKTAIGVLGDLADTLGSHVGGLIQQSVSSKEFLNECLSSEDHTIKEAAEWAKHAITRAISV

SEQ ID NO: 13 - DNA, 1957 bp, Arabidopsis thaliana
tatcactctctcattaatcgaacttggcgtgtttaaataatcttccgatcgttaattctcttccgatttcgattcgattttagcggcgatgtctctcagacctagcgcgaagacggaggtgcgacggaatcggtacaaagtagcggtcgatgcggaggaaggacggcggaggcgagaggataacttggttgagatcaggaagaacaagagagaggaaaatttgcagaagaagagatttacgtcttctatggcttttggctcagcaacgggacaaacggaacaggatctttcttcagcgaaccaattaaaagataatctacctgctatggttgctggaatctggtcagaggatagcaattcacaattggaggcaacaaatctcttgcggaaactgctttctattgaacaaaatcctcctatcaatgaagttgtacaatctggtgttgttcctcgtgttgtgaagtttctttccagggatgacttccccaaacttcagtttgaggcagcttgggcgctcaccaacattgcttcagggacatcagagaacacaaatgtcatcattgaaagtggagctgtcccgatattcatccaacttctcagctctgctagtgaagatgtccgcgaacaggctgtttgggcattgggaaatgttgctggagactcaccaaaatgccgggatttagtcctaagttacggtgccatgacacctcttctgtctcaattcaatgagaatacaaagctttcaatgctgagaaatgctacatggacattatcaaacttctgcagagggaagcccccacccgcatttgaacagacacaaccagctttaccagttcttgagcgccttgtgcaatcaatggatgaagaagttctcacagatgcatgctgggctctgtcatacctctcggataattcaaacgacaaaatacaagcagtcattgaagcaggagttgttcctcgcctcatccagctcttaggtcattcgtcgccatcagtgctgattcctgctcttcgtaccattggaaatattgtaaccggggatgatctacagactcagatggttctcgaccagcaagcgcttccttgtcttttgaaccttctaaaaaacaattacaagaagagtatcaagaaggaagcttgctggactatctccaacattacagctggaaatgcagatcagatacaagcagtgattgatgcaggtataatccagtctcttgtttgggtgcttcaaagtgcagagttcgaagtaaaaaaagaagctgcttggggaatatcaaatgctacttctggtggcactcatgatcaaatcaagtttatggtgagccaaggctgtatcaaacctctatgcgatctccttacttgcccagatctgaaagttgtaacggtttgcttagaagcactagagaacattctcgtggttggagaagcagagaagaacttaggtcacacaggagaagacaacctctacgctcaaatgattgacgaagcagaagggttagagaagattgagaatcttcagagtcacgacaacaatgatatctacgacaaagccgtgaagatcctcgaaacattttggactgaagacaatgaagaagaaggcaacgacgagaatcatgctccacaatctggtttccagttcggaagcaccaatgttcctcctggtcaattcaactttatttgaaaggtaaaatagttgaattgggtcatagaagttgcttggacttttaagtaagccacatatcgaacgaaagtggtaacatcacaaagatgaaatatcaatcttctctatctcttcatgcccactccttaactcgtggacatgaactatgaagaaacatagtacgattttcttttctttttggaagtttgtctcaataactaaatcatttggggaagagaaacaattattctgtgttagccatcatctcgtctttcaacaaagttcccttttttc

SEQ ID NO: 14 - protein, 531 aa, Arabidopsis thaliana
MSLRPSAKTEVRRNRYKVAVDAEEGRRRREDNLVEIRKNKREENLQKKRFTSSMAFGSATGQTEQDLSSANQLKDNLPAMVAGIWSEDSNSQLEATNLLRKLLSIEQNPPINEVVQSGVVPRVVKFLSRDDFPKLQFEAAWALTNIASGTSENTNVIIESGAVPIFIQLLSSASEDVREQAVWALGNVAGDSPKCRDLVLSYGAMTPLLSQFNENTKLSMLRNATWTLSNFCRGKPPPAFEQTQPALPVLERLVQSMDEEVLTDACWALSYLSDNSNDKIQAVIEAGVVPRLIQLLGHSSPSVLIPALRTIGNIVTGDDLQTQMVLDQQALPCLLNLLKNNYKKSIKKEACWTISNITAGNADQIQAVIDAGIIQSLVWVLQSAEFEVKKEAAWGISNATSGGTHDQIKFMVSQGCIKPLCDLLTCPDLKVVTVCLEALENILVVGEAEKNLGHTGEDNLYAQMIDEAEGLEKIENLQSHDNNDIYDKAVKILETFWTEDNEEEGNDENHAPQSGFQFGSTNVPPGQFNFI

SEQ ID NO: 15 - DNA, 1937 bp, Arabidopsis thaliana
ctgattctcctgctccttcgtcttcttcatcttcctctgagaaatcaaaaactcgatcgatcaattcgttgttcgtctacatcgattccttcagaacctagtgatcctctgttttggttgattcgattaagctaaccatgtcttacaaaccaagcgcgaagactgaggttcgccggaacaggtataaagtatctgtggacgccgatgaaggtcgccggagacgggaggataacatggtggagatccggaagaacaagagagaggagaacttgcagaagaagcggcgtgaaggttttaatccttccatggcgtcacagccagggcaggatttctcctcgtctctccctacggaaacgagattggagaatatacaacagatgattgctggagtaatgtcagaggatagagacttacaattggaggcgacggctagcttcaggagattgctttcaattgagcgaaatcctccaatcaatgaagttgttcaatctggtgttgttcctcacattgtgcaatttctttccagggatgacttcactcaacttcagtttgaggcagcttgggcgcttaccaatatcgcttcagggacatctgagaacactagggtcattattgatagtggtgctgtccctttattcgtcaaacttcttagttctgcaagtgaggaagttcgagaacaggctgtatgggcattgggaaacgttgctggtgactcgccaaaatgtcgtgatcatgtcctaagttgtgaggctatgatgtctcttctggctcaattccatgagcattcaaagctctccatgctgaggaatgctacatggacattatcaaatttctgcagagggaagccgcagcctgcatttgaacagacaaaagcagctttaccagctcttgagcgccttctgcattcaaccgacgaagaagttctcacagatgcatcctgggctctctcatatctctctgatggtacaaacgagaaaatacaaactgttatcgacgctggtgtcatccctcgccttgttcagctcttggctcatccatcgccctcagttctgattccagctctccgtacaattggtaacattgtaaccggagatgatattcagactcaggcggttattagcagtcaagcgcttcctggtctgttaaaccttttgaagaacacatacaagaagagtatcaagaaggaagcttgctggactatctctaacattacagctgggaacacaagtcaaattcaagaagtgtttcaggcaggcattattcggcctctgattaacctgcttgagatcggtgaattcgaaattaagaaagaagctgtttgggcaatctctaatgcaacttctggtggcaatcatgaccaaatcaagtttctcgtgagccaaggctgcatcagacccctgtgtgatctcctaccgtgtcccgatccaagggttgtcacagtgactttggaaggtctagaaaacattctcaaagtaggtgaagccgagaagaatctaggcaacacaggaaacgataatctgtacgcgcagatgattgaagacgcagatggtttggacaagattgagaatcttcagagtcacgataataatgagatttatgagaaagcagtcaaaatcctggagtcgtattgggctgcagatgacgaggaggaagatattggcggtgtggatgctcctgagaatgttcagtcttccggtttccaattcggaaaccaaagtggtaatgctcctacgggtggattcaactttggttgaaggtttctgtagtattctctcagttgcttgaacttaagaacaaaggtcgctcgttgtcttttctaaaaacagtttaggtttttttttctcttttttgggtcatgttttgagtgaattttgtatttttagaagtttggatattttgttctctcgcgtttaaggcggaaattaaagtgtttcact

SEQ ID NO: 16 - protein, 538 aa, Arabidopsis thaliana
MSYKPSAKTEVRRNRYKVSVDADEGRRRREDNMVEIRKNKREENLQKKRREGFNPSMASQPGQDFSSSLPTETRLENIQQMIAGVMSEDRDLQLEATASFRRLLSIERNPPINEVVQSGVVPHIVQFLSRDDFTQLQFEAAWALTNIASGTSENTRVIIDSGAVPLFVKLLSSASEEVREQAVWALGNVAGDSPKCRDHVLSCEAMMSLLAQFHEHSKLSMLRNATWTLSNFCRGKPQPAFEQTKAALPALERLLHSTDEEVLTDASWALSYLSDGTNEKIQTVIDAGVIPRLVQLLAHPSPSVLIPALRTIGNIVTGDDIQTQAVISSQALPGLLNLLKNTYKKSIKKEACWTISNITAGNTSQIQEVFQAGIIRPLINLLEIGEFEIKKEAVWAISNATSGGNHDQIKFLVSQGCIRPLCDLLPCPDPRVVTVTLEGLENILKVGEAEKNLGNTGNDNLYAQMIEDADGLDKIENLQSHDNNEIYEKAVKILESYWAADDEEEDIGGVDAPENVQSSGFQFGNQSGNAPTGGFNFG

SEQ ID NO: 17 - DNA, 3026 bp, Arabidopsis thaliana
tctctctctccttcgacagtttcaagtacagactctctctctgtctctgcaaactctagggtttggtttttgctcttcttcgagaagctttttgtggatagaatctgcagtgagagggacgtggtgtttaaattgaagcgaaaaaccctagcgtttacgcaaaccttaatttccagagaccagaatggcgatggagatcacacagtttctgttggctgcccagtcagccgatgcaagagtccggactgaagcagagggtaatctcaggcaattccaagaacagaacttgccgctgttcttagtatccttgtcttttgagcttgccaacaatgataaacctgctgaatcccgtcgactagccggtattctgctaaagaattctctggacgccaaagattctgccacaaaagatcatctggtgaaacaatggtttgcaattgatgttgctcttaaatcccagatcaaggatcgcttactaagaactcttggttcatctgccctagaggcaaggcatacttcagctcaggttattgctaaggtagcctccattgaaattcctcagaagcagtggcctgaacttgttggatcgctgcttaacaatatgactcagcaaggcagtcccgcacacttgaagcaatcaaccttggaaactctaggctatgtctgtgaagagatatcacaccatgatcttgtgcaagatgaagtgaattctgtcctcacagcagttgtgcagggcatgaaccagtctgaaaatactgctgaagttcgtctcgcagcaacaaaggcactgtgtaatgccttggatttctctcagacaaattttgagaatgaaatggagaggaattacatcatgaagatggtatgcgagacagcatgttccaaggaggcagagatcaggcaagctgctttcgagtgccttgtgtccattgcatccacatactatgaggtgctggagcactacatacaaacactctttgagctcacatcgaatgctgtaaagggagatgaagagagcgtttccctccaagcaattgagttctggagttccatctgtgatgaagagatcgaccgtcaagagtatgacagtcctgctagtggtgactcatctcctccccactcctctttcatagagaaggctcttccccatttagttcaaatgttgctagaaactctgctgaagcaggaagaggatcaggaccatgatgacgacgtctggaacatatctatggctggcgggacatgccttggcctggttgccagaacagttggagatcatgtagtccctcttgtgatgccttttgttgaaaaaaacataagttcgccagattggcgctgccgggaggcagccacttatgcttttggatcaattttggagggcccaacaattgataagcttgccccgatggttgctgctggcttggaatttctccttaatgcaaccaaggatcagaataaccatgtcagggatacaactgcttggactctgagccgtatctttgaatttttgcactccccagacagtggtttctctgttatatcacccgaaaacctccctagaattgtgagtgtattactggaatcaattaaagatgtgccaaatgttgcagagaaggtctgtggagcaatatacaatcttgcacagggatatgaagactctggagcaagttcatctcttctctctccttatcttacagagatcatcacacatctgcttgcagctgctgagcgtacagatggggcagagtctaagctaagaggtgctgcgtatgaaaccttgaacgaggttgtccggtgttcaaacctttcagaggcctcaagcatcatagcgcatctcctccctgccatcatgaaaaaattagctgagacaatggacctccctataatatcaactgatgaccgtgagaagcaagcggaagtccaggcttctctgtgtggtgttctccaagttataatccagaagctgagcggcagggaggatacgaaacccatcataatgcagagcgcagatgacattatgaggctgttcctaagagtgtttggatgccatagttcaagtgtccacgaagaagccatgcttgcaatcggtgctcttgcatatgctactggagctgagtttgtgaaatacatgcccgagcttttcaaatatctccagatggggctgcagaatttcgaagaataccaagtctgctcaatcacagtaggagtgcttggtgacatttgccgtgccctggatgaaaaaatcctacctttttgcgatcagataatgggtctccttatccaaaaccttcaaagtggggcactccacagatcagtgaagcctccaatattctcatgctttggagacattgctctggcaattggtgctcattttgaaaggtatgtagcaccagccgttcagatcatgcaaggggctgctcaggtgtgtgctcagatggatacccttgacgaggagcttatggattatgcaaaccaactgcggagaagcatctttgaggcatactccgggatactacaagggttcaaggacacaaaagccgagctcatgatgccctacgctcaacatctcctgcagtttgttgaactagtatccaaagatcccctgagggatgagagcgtgacaaaagccgcggttgcagcgatgggtgatcttgcggatgttgtaggagagaacacaaagcagttgttccaaaacttcaccttcttcggtgagttccttaatgagtgtctcgaatcagaggatgaagatctcaaggtcactgcacgctggactcaaggaatgattgcaaggctcatgcacccatcataaatttaaccctctattttttttgcatgtcgtctttccgcttctctctatcgtatcatgtgaatagtggttagtttttttttgggtaaaagtagtttaattcccctcaggccatatctgtttgaggttgggtcttattttgttctcttggggtagttaatgcaaaactcttttattgttctttggttactccattatcaatcaaagtatcgttggtcgctct

SEQ ID NO: 18 - protein, 873 aa, Arabidopsis thaliana
MAMEITQFLLAAQSADARVRTEAEGNLRQFQEQNLPLFLVSLSFELANNDKPAESRRLAGILLKNSLDAKDSATKDHLVKQWFAIDVALKSQIKDRLLRTLGSSALEARHTSAQVIAKVASIEIPQKQWPELVGSLLNNMTQQGSPAHLKQSTLETLGYVCEEISHHDLVQDEVNSVLTAVVQGMNQSENTAEVRLAATKALCNALDFSQTNFENEMERNYIMKMVCETACSKEAEIRQAAFECLVSIASTYYEVLEHYIQTLFELTSNAVKGDEESVSLQAIEFWSSICDEEIDRQEYDSPASGDSSPPHSSFIEKALPHLVQMLLETLLKQEEDQDHDDDVWNISMAGGTCLGLVARTVGDHVVPLVMPFVEKNISSPDWRCREAATYAFGSILEGPTIDKLAPMVAAGLEFLLNATKDQNNHVRDTTAWTLSRIFEFLHSPDSGFSVISPENLPRIVSVLLESIKDVPNVAEKVCGAIYNLAQGYEDSGASSSLLSPYLTEIITHLLAAAERTDGAESKLRGAAYETLNEVVRCSNLSEASSIIAHLLPAIMKKLAETMDLPIISTDDREKQAEVQASLCGVLQVIIQKLSGREDTKPIIMQSADDIMRLFLRVFGCHSSSVHEEAMLAIGALAYATGAEFVKYMPELFKYLQMGLQNFEEYQVCSITVGVLGDICRALDEKILPFCDQIMGLLIQNLQSGALHRSVKPPIFSCFGDIALAIGAHFERYVAPAVQIMQGAAQVCAQMDTLDEELMDYANQLRRSIFEAYSGILQGFKDTKAELMMPYAQHLLQFVELVSKDPLRDESVTKAAVAAMGDLADVVGENTKQLFQNFTFFGEFLNECLESEDEDLKVTARWTQGMIARLMHPS

SEQ ID NO: 19 - DNA, 3167 bp, Arabidopsis thaliana
agtctcctcattatctctgcctcctttccacacagtcgactctttttctctctgcaagtctagggtttttctgatccaccagaggtttttcccctgcttcgagcgccgtcttggagaagctttttctcgataggctttgcagtgacagggacacagggtttggattgaagcgaaaaaccctagcgtttacgcgtcttctcaagcgaaaaaatccttaatttccacagagaagaatggctatggagatcacacagttccttctggctgcccagtcagccgatgcaagagtccgtactgaagcagaggctagtctcagacagttccaagaacaaaacttgccgctgttcttgttatccttgtcttttgagcttgaaaacaatgataaacctgctgaatcccgtcgactagccggtattctgctaaagaattctctggacgccaaagattctgccacaaaagatcatctggtgaaacaatggtttgcaattgatgttgctcttaaatcccagatcaaggatcgcttactaagaactcttggttcatctgccctagaggcaaggcatacttcagctcaggttattgctaaggtagcctccattgaaattcctcagaagcagtggcctgaacttgttggatcgctgcttaacaatatgactcagcaaggcagtcccgcacacttgaagcaatcaaccttggaaactctaggctatgtctgtgaagagatatcacaccatgatcttgtgcaagatgaagtgaattctgtcctcacagcagttgtgcagggcatgaaccagtctgaaaatactgctgaagttcgtctcgcagcaacaaaggcactgttaaatgccttggatttctctcagacaaattttgagaatgaaatggagaggaattacatcatgaagatggtatgcgagacagcatgttccaaggaggcagagatcaggcaagctgctttcgagtgccttgtgtccattgcatccacatactatgaggtgctggagcactacatacaaacactctttgagctcacatcgaatgctgtaaagggagatgaagagagcgttgccctccaagcaattgagttctggagttccatctgtgatgaagagatcgaccgtcaagagtatgacagtcctgatagtggtgactcatcccctccccactcctgtttcatagagaaggctcttccccatttagttcaaatgttgctagaaactctgctgaagcaggaagaggatcaggaccatgacgacgatgtctggaacatatctatggctggcgggacatgccttggcctggttgctagaacggttggagatggtgtagtccctcttgtgatgccttttgttgaaaaaaacataagttcgccagattggcgaagccgggaggcagccacttatgcttttggatcaattttggagggcccaacaattgataagcttgccccgatggtagctgctggcttggaatttctccttaatgcaaccaaggatcagaataaccatgtcagggatacaactgcttggactctgagccgtatctttgaatttttgccatccccagacagtggcttctctgttatatcacccgaaaacctccctagaattgtgagtgtattactggaatcaattaaagatgtgccaaatgttgcagagaaggtctgtggagcaatatacaatcttgcacagggatatgaagactctggagcaagttcctctcttctctctccttatcttacagagatcatcacacatctccttgcagctgctgagcgtacagatggggcagagtctaagctaagaggtgctgcgtatgaaaccttgaacgaggttgtccggtgttcaaacctttcagaggcctcaagcatcatagcgcatctcctccctgccatcatgaaaaaattagctgagacaatggacctccctataatatcaactgatgaccgtgagaagcaagcggaactccaggcgtctctgtgcggtgttctccaagtcataatccagaagctgagcagcagggacgatatgaaacctatcatagtgcaaaacgcagatgacatcatgaggttattcctaagagtgtttggttgccatagttcaagtgtccacgaagaagccatgcttgcaatcggtgctcttgcctatgcgactggaactgagtttgtgaaatacatgcccgagctttttaaatatctccagatggggctgcagaatttcgaagaataccaagtctgctcaatcaccgtaggagtgattggtgacatatgccgtgcgctggatgaaaaaatcctacccttttgcgatcagataatgggtctccttatccaaaaccttcaaagtggtgcactccacagatcggtgaagcctccaatcttctcatgctttggagacattgctctggcgattggtgctcattttgaaaggtatgtagctccagctgttcagataatgcaaggtgctgctcaggtgtgtgcgcagatggacacccttgacgaggagcttatggattatgcaaaccaactccggagaagcatctttgaagcatactccgggatactgcaagggttcaaggatgcaaaggctgagctcatgatgccctatgctcaacatctgttgcagtttgttgaactagtatccaaagattccctgagggatgagagcgtgacaaaagccgcggttgcagcaatgggtgatcttgcggatgttgtaggggagaacacgaagcagttgttccaaaacttcaccttctgtgatgagttcctcaatgagtgtctcgaatcagaggatgaagatctcaaggtcactgcacgctggactcaaggaatgatcgcaagactcgtgctctaatcataaatttaaaggcttttccatcatcactactcgtgcgtctctctctctctgtcgtcattgttttgagtaaaggtttcaaagaatagttgcgggtcttcctctttgctctgtctaatgatgttgggatagtggttaaggggggttttgggaaattgttttggggctatctctgttttgatgctgcgtcttattttttactctgtagaagaaaaacaaaatcttttctttttttttggtgaatggaattatccacttatcggtggtcactttttgagtcaactttatgattctatgtttcttaacgtgaacaatttc

SEQ ID NO: 20 - protein, 871 aa, Arabidopsis thaliana
MAMEITQFLLAAQSADARVRTEAEASLRQFQEQNLPLFLLSLSFELENNDKPAESRRLAGILLKNSLDAKDSATKDHLVKQWFAIDVALKSQIKDRLLRTLGSSALEARHTSAQVIAKVASIEIPQKQWPELVGSLLNNMTQQGSPAHLKQSTLETLGYVCEEISHHDLVQDEVNSVLTAVVQGMNQSENTAEVRLAATKALLNALDFSQTNFENEMERNYIMKMVCETACSKEAEIRQAAFECLVSIASTYYEVLEHYIQTLFELTSNAVKGDEESVALQAIEFWSSICDEEIDRQEYDSPDSGDSSPPHSCFIEKALPHLVQMLLETLLKQEEDQDHDDDVWNISMAGGTCLGLVARTVGDGVVPLVMPFVEKNISSPDWRSREAATYAFGSILEGPTIDKLAPMVAAGLEFLLNATKDQNNHVRDTTAWTLSRIFEFLPSPDSGFSVISPENLPRIVSVLLESIKDVPNVAEKVCGAIYNLAQGYEDSGASSSLLSPYLTEIITHLLAAAERTDGAESKLRGAAYETLNEVVRCSNLSEASSIIAHLLPAIMKKLAETMDLPIISTDDREKQAELQASLCGVLQVIIQKLSSRDDMKPIIVQNADDIMRLFLRVFGCHSSSVHEEAMLAIGALAYATGTEFVKYMPELFKYLQMGLQNFEEYQVCSITVGVIGDICRALDEKILPFCDQIMGLLIQNLQSGALHRSVKPPIFSCFGDIALAIGAHFERYVAPAVQIMQGAAQVCAQMDTLDEELMDYANQLRRSIFEAYSGILQGFKDAKAELMMPYAQHLLQFVELVSKDSLRDESVTKAAVAAMGDLADVVGENTKQLFQNFTFCDEFLNECLESEDEDLKVTARWTQGMIARLVL

SEQ ID NO: 21 - DNA, 1629 bp, Brassica napus
atgtcgctgaggccgagcacacgcgcggagctgaggaagaagatatacaagacaggtgtcgatgccgatgaggcgaggcggaggagagaagacaacctcgtcgagattcgaaaaaacaagcgcgaggacagtctcctcaagaaacgccgcgaaggcatgatgctccagcagcagcagcagcctctcggagcagctggtctcgatgccctccagagcgctgccgccgttgagaaacgattggaaggtataccaatgatggtacaaggtgtttattctgaggatcctcaagctcagctagaagctactactcagtttagaaagttgttatctattgagcgcagtcctccaattgatgaggtgatcaaagctggtgttatccctcgttttgttgagtttcttcgaaggcaagaccatccacaactccagtttgaggctgcatgggctttgaccaacgttgcgtcaggaacatcagatcatactcgggttgtgattgaacatggggcggtacctatcttcgttgagcttcttagctctgctagtgatgacgttcgagagcaggccgtgtgggccttggggaatgttgctggagactcgccaaactgcaggaaccttgttctcagctgtggtgctcttgcacccttgctgtctcagttaaacgaaaattcaaagttatccatgctaaggaatgctacatggaccttgtccaacttttgtcgtgggaaaccaccaacaccatttgaagaggtgaagcctgccttgccagttctccggcagcttatttatctgaatgatgaagaagttctcactgatgcatgctgggctctctcctacctttcagatggccccaatgataagattcaggctgtgatccaggcaggtgtctgtccacgacttgtggagcttctgagtcatccatcacctacggttctcattcctgccctccgaaccgttgggaacattgtaaccggtgatgactctcagacacagtttataattgatagtggagtacttccacacctttataatttgcttacgcaaaatcacaagaaaagtatcaaaaaagaagcttgttggacaatctcgaatatcactgctgggaataaagttcagatagaggctgtagttggcgctggtattgtcctccctcttgtgcatttgctccaaaacgcggagttcgatataaagaaggaagctgcgtgggctatttcaaatgctacctcaggagggtctcatgagcagattcagtatttggtagcacaaggctgcatcaagcctctttgtgatcttctaatttgccctgatccgaggatcgtgacagtgtgcttagaggggcttgagaacattctcaagattggtgaggctgacaaggagatggggttaaacggtggagtaaatctctatgctcagatagttgaagaatctgatgggttggacaaaattgaaaaccttcagtcccatgataacaatgagatatatgagaaggctgttaagatcttggagagatattgggctgaggaagaagaggatgagcagattctgccagacggtgtgaatgaaaatccacaacagggcttcagttttgggaataaccagaccgctgctccccctggtggatttaaatttggttga

SEQ ID NO: 22 - protein, 542 aa, Brassica napus
MSLRPSTRAELRKKIYKTGVDADEARRRREDNLVEIRKNKREDSLLKKRREGMMLQQQQQPLGAAGLDALQSAAAVEKRLEGIPMMVQGVYSEDPQAQLEATTQFRKLLSIERSPPIDEVIKAGVIPRFVEFLRRQDHPQLQFEAAWALTNVASGTSDHTRVVIEHGAVPIFVELLSSASDDVREQAVWALGNVAGDSPNCRNLVLSCGALAPLLSQLNENSKLSMLRNATWTLSNFCRGKPPTPFEEVKPALPVLRQLIYLNDEEVLTDACWALSYLSDGPNDKIQAVIQAGVCPRLVELLSHPSPTVLIPALRTVGNIVTGDDSQTQFIIDSGVLPHLYNLLTQNHKKSIKKEACWTISNITAGNKVQIEAVVGAGIVLPLVHLLQNAEFDIKKEAAWAISNATSGGSHEQIQYLVAQGCIKPLCDLLICPDPRIVTVCLEGLENILKIGEADKEMGLNGGVNLYAQIVEESDGLDKIENLQSHDNNEIYEKAVKILERYWAEEEEDEQILPDGVNENPQQGFSFGNNQTAAPPGGFKFG

SEQ ID NO: 23 - DNA, 1596 bp, Glycine max
atgtcgctgaggccgaatgctagaaccgaggttcgccgcaaccgctacaaggtggcggtggacgccgacgagggtcgccggaggagggaggacaacatggtggagatccgcaagagcaagcgcgaagagagcctccagaagaagcgccgcgaaggcctccaagctcagcagcagttccccactcctctccaagccgcctccattgtcgagaaaaagttagagagtcttcctgcgatggttgctggagtgtggtccgatgataacagccagcaactggaagcgaccacgcagtttcggaaactgctttcgattgagcgcagtcctccaattgaggaagttattcaagctggggttgtgcctcgatttgtggagtttcttgttagggaggatttccctcaacttcagtttgaggctgcgtgggctctcacaaacatagcatctggaacttctgagaataccaaggtggtgattgatcatggggcagttccgatatttgtcaagctacttagttcgcccagtgatgatgttcgggagcaggcagtgtgggcattggggaatgttgctggtgactctcctaagtgtcgtgatcttgttctcagccatggtgccctgatcccactgttggcccagttgaatgaacatgcaaaactttcaatgttgagaaacgcgacatggaccctgtcaaacttctgcaggggcaagccacagcctccatttgagcaggtgagggcagcgcttcctgctctagaacgattggttttttccaatgatgaagaagtcttgacagacgcatgttgggcactatcatatctttccgatggaacaaatgacaaaatccaagccgttattgaggctggtgtgtgtcccagactggtgcagctccttctgcacccatccccttcagtgctgattcctgctcttcgcacagtgggaaatattgtgacaggagatgatatgcagactcagactatcatcaatcatggtgcgctcccatgcctcttgagcctgttgacacataatcataaaaaaagtatcaagaaagaagcttgctggaccatttcaaacattacagctggaaacagagatcagatacaggctgttgttgaagctggtttgattgccccccttgtcaatcttcttcaaaatgctgagtttgacattaaaaaagaagctgcttgggcaatctcaaatgctacatctggtggtacccatgagcagatcaagtatctggtgagccagggttgcattaagcctctctgtgatctgcttgtttgcccggacccaagaatcgtcactgtctgtttagaaggacttgagaatattctgaaggttggggaagctgagaagagcatgggtaacagtggagatgtcaacttgtatgcacagatgatagacgaagcagagggattggagaaaattgaaaacctgcagagtcatgacaacaatgaaatatatgaaaaggctgttaaaattcttgagacatattggttggaagacgatgatgagacactacctacaggcgatggtgctcaacctggttttaattttggaaacaatgatgttccagttccatctggtggattcaactttagttga

SEQ ID NO: 24 - protein, 531 aa, Glycine max
MSLRPNARTEVRRNRYKVAVDADEGRRRREDNMVEIRKSKREESLQKKRREGLQAQQQFPTPLQAASIVEKKLESLPAMVAGVWSDDNSQQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPKCRDLVLSHGALIPLLAQLNEHAKLSMLRNATWTLSNFCRGKPQPPFEQVRAALPALERLVFSNDEEVLTDACWALSYLSDGTNDKIQAVIEAGVCPRLVQLLLHPSPSVLIPALRTVGNIVTGDDMQTQTIINHGALPCLLSLLTHNHKKSIKKEACWTISNITAGNRDQIQAVVEAGLIAPLVNLLQNAEFDIKKEAAWAISNATSGGTHEQIKYLVSQGCIKPLCDLLVCPDPRIVTVCLEGLENILKVGEAEKSMGNSGDVNLYAQMIDEAEGLEKIENLQSHDNNEIYEKAVKILETYWLEDDDETLPTGDGAQPGFNFGNNDVPVPSGGFNFS

SEQ ID NO: 25 - DNA, 888 bp, Gossypium hirsutum
atggactcccttaacttttgtcggggaaagccccagcctccctttgatccggttaaacctgcacttcctgcattgacacaccttattcattcgaatgatgaagaagtcttaactgatgcatgttgggcgctctcatatctttctgatggtacaaatgacaaaatccaagctgttatagaagcaggtgtttgtgggcgtctggtggagctcttgatgcacccatctccttcagtgctaatacctgctcttcgcacagttggaaatattgtcacaggagatgatggtcaaacccagtgtattatcaatcatcaagtgttgccatgccttctaaacctcttgacaaataatttcaaaaagagcatcaagaaggaagcttgttggacaatctcaaatatcacagctggaaataaggagcagatacaggctgtaattgaagctaatattatatctccactggttcatctgcttcaaaatgctgaatttgatatcaagaaagaagcggcatgggccatctcaaatgccacatctggtggtactcatgatcagatcaaattccttgttagtcaaggttgtataaagccattgtgtgatcttcttaactgccctgatccaaggattgtaacagtctgtttagaagggcttgaaaacattttgaaggtaggagaagctgataagaacctgggcactaccggaggagtgaatctctatgcacaaatgattgatgatgctgagggtctggagaagatcgagaatttacagtcccacgataacactgagatttatgaaaaggctgtgaaagtctcgagacatattggtttggaggaggagaatgaaacaatgccgcgggtgatgcctcctcaacaggggtttcctttttggcgggggtga

SEQ ID NO: 26 - protein, 295 aa, Gossypium hirsutum
MDSLNFCRGKPQPPFDPVKPALPALTHLIHSNDEEVLTDACWALSYLSDGTNDKIQAVIEAGVCGRLVELLMHPSPSVLIPALRTVGNIVTGDDGQTQCIINHQVLPCLLNLLTNNFKKSIKKEACWTISNITAGNKEQIQAVIEANIISPLVHLLQNAEFDIKKEAAWAISNATSGGTHDQIKFLVSQGCIKPLCDLLNCPDPRIVTVCLEGLENILKVGEADKNLGTTGGVNLYAQMIDDAEGLEKIENLQSHDNTEIYEKAVKVSRHIGLEEENETMPRVMPPQQGFPFWRG

SEQ ID NO: 27 - DNA, 1575 bp, Hordeum vulgare
atgtcggtgcgcccgagcgagagggccgacgcgcggcggaaccgctacaaggtgacggtggacgccgatgaggggcggcggcggcgcgaggacaacatggtggagatccgcaagaaccgccgcgaggagagcctcctcaagaagcgccgcgaggggctccaggcccaggctcccatacccgccgccggcgtcgagaagaagcttgaaagcttacctgctatggttggtggggtttattcggaggataacaacctgcagcttgaggcaacgacacaattccgcaagttgctttctatagaaaggagccccccaatcgaagaagttatccaatcaggcgttgttcctcgatttgtgcagtttcttactagggaggatttcccccaactccagtttgaagcagcgtgggcactcacaaacattgcgtctggcacatcagagaataccaaggttgtcattgatcatggggcagttccaatatttgtgaagcttcttgcgtctggcagtgatgatgttcgtgagcaggcggtctgggcactgggcaatgttgctggtgactccccaaagtgccgtgaccttgttctcgcaaatggcgcattgatgcctctgctagcacagttgaatgagcatgctaaactctccatgttaaggaatgcgacctggactttatcaaatttctgcagaggaaagccacaaccagcatttgatcagactaagcctgctctgccagcacttgcacgacttatccattccaatgatgaggaagttttaactgatgcatgctgggctctttcctatctctctgatggcaccaatgacaagatccaatctgtgattgatgctggtgtctgtccccgacttgtggagcttctcctccatccatcaccttcagtgcttatacctgcactacgaactgttggaaatattgtcacaggagatgactcacaaactcagtgcatcattgatcatcaagctcttgggtgtctcctcagtctgttgacagaaaatcacaagaaaagcattaagaaagaggcctgctggactgtttcaaatatcactgctggtaacaaagatcagatacaggctgtgattactgctggaattatttttcctttggtgcatctgctgcaaacggctgagtttgatatcaagaaggaggctgcttgggccatctcgaatgctacctccggtggttcccatgaccaaataaagtatttggttagcgagggctgcatcaagccactgtgtgacctcctcctttgcccagatccaagaatcgttacagtttgcttggagggtcttgagaacattctcaaagttggagaaactgataagaatttgggtgcttctggggagggaaatgtctatgcacagatgattgatgaagcagaaggcctggaaaagattgagaacctgcagagccatgataacaatgaaatctatgagaaggctgtgaagattcttgaggcttactggatggaggaggaagatgatgcgatggggacaactatggaagctcccacaggtgttgcctttgactttggccaaggtggcaaccctgatctgaacttgggctga

SEQ ID NO: 28 - protein, 524 aa, Hordeum vulgare
MSVRPSERADARRNRYKVTVDADEGRRRREDNMVEIRKNRREESLLKKRREGLQAQAPIPAAGVEKKLESLPAMVGGVYSEDNNLQLEATTQFRKLLSIERSPPIEEVIQSGVVPRFVQFLTREDFPQLQFEAAWALTNIASGTSENTKVVIDHGAVPIFVKLLASGSDDVREQAVWALGNVAGDSPKCRDLVLANGALMPLLAQLNEHAKLSMLRNATWTLSNFCRGKPQPAFDQTKPALPALARLIHSNDEEVLTDACWALSYLSDGTNDKIQSVIDAGVCPRLVELLLHPSPSVLIPALRTVGNIVTGDDSQTQCIIDHQALGCLLSLLTENHKKSIKKEACWTVSNITAGNKDQIQAVITAGIIFPLVHLLQTAEFDIKKEAAWAISNATSGGSHDQIKYLVSEGCIKPLCDLLLCPDPRIVTVCLEGLENILKVGETDKNLGASGEGNVYAQMIDEAEGLEKIENLQSHDNNEIYEKAVKILEAYWMEEEDDAMGTTMEAPTGVAFDFGQGGNPDLNLG

SEQ ID NO: 29 - DNA, 1686 bp, Medicago truncatula
atgtcgctcagacccaatgcaagaacagaggttcgtcgcaaccgttacaaagttgccgtcgatgccgatgaaggtcgccggagaagagaggataacatggtcgagatccgtaaaagtaagcgtgaagaaagtctcttgaagaaacgtcgtgaaggtcttcaaaatcaaccgcagtttactcctcttcaatcttcctccattgtcgagaaaaagttggagagtcttcctgcaatggttgctggtgtttggtcagatgataataatcaacaacttgaagcaactacgcaatttcggaagcttctttccatagagcgaagccctccgattgaggaagttattcaatctggtgttgttccccgctttgttcagtttctagttcgggaggattttccccaacttcagtttgaggctgcttgggctcttacaaacatagcatccggaacttctgagaatactaaggtggtaattgatcatggggcagtgccgatatttgtgaagctacttagttctccaagtgatgatgttcgggagcaggctgtgtgggcattgggaaatgttgctggtgattcacctaggtgccgcgatcttgttcttagccatggtgccctgatcccgctgttaacccagttgaatgagcaggcaaagctttcaatgctgagaaatgccacatggactctgtcaaacttttgcaggggcaagccacaacctccatttgatcaggtgaggccagcacttccggctcttgagcgtttggttttttcaaatgatgaagaagtcctgacagatgcatgctgggcactctcttatctttctgatggaacaaatgacaaaatccaagcggtgattgaggcaggtgtatgtggcagactagtgcagctccttctgcacccatctccttcagtgctgatccctgcacttcgcacggtgggaaatattgttacgggagatgatgcacagactcaggctattattggtcatggttcactcccatgtcttttgagcctgttgacccataatcacaagaaaagtattaagaaagaagcttgctggactatatcaaacattacagctggaaacaaagagcagatacaggctgttattgaagccggactgattgctcctctggtcaatcttcttcaaaatgccgaatttgacattaaaaaagaagctgcatgggcactctccaatgctacatctggcggtacccatgagcaaatcaagtacttggtgagccagggttgcattaagcctctgtgtgatcttcttgtttgccccgatccaagaattgttaccgtctgtttagaaggtcttgagaatattctgaagattggagaagcagagaaaagctttggtaacgcgggagatgtcaacttgtatgctcagatgatagatgaggcggagggattggaaaagattgagaacctgcagagtcatgacaacaatgaaatttacgagaaggctgttaaaattctcgagacatattggttggaagatgaagacgagacactaccaccaggcgatggttctcaacctggttttaattttggaggcaatgaccttccggtcccatctggaaggaactgtgttggatgcagcagggtactgttggcgttgagtccgggtggggtgggggagggggggcgtcggtctttgtacttcatggtgtctggtgtcagtctggtctag

SEQ ID NO: 30 - protein, 561 aa, Medicago truncatula
MSLRPNARTEVRRNRYKVAVDADEGRRRREDNMVEIRKSKREESLLKKRREGLQNQPQFTPLQSSSIVEKKLESLPAMVAGVWSDDNNQQLEATTQFRKLLSIERSPPIEEVIQSGVVPRFVQFLVREDFPQLQFEAAWALTNIASGTSENTKVVIDHGAVPIFVKLLSSPSDDVREQAVWALGNVAGDSPRCRDLVLSHGALIPLLTQLNEQAKLSMLRNATWTLSNFCRGKPQPPFDQVRPALPALERLVFSNDEEVLTDACWALSYLSDGTNDKIQAVIEAGVCGRLVQLLLHPSPSVLIPALRTVGNIVTGDDAQTQAIIGHGSLPCLLSLLTHNHKKSIKKEACWTISNITAGNKEQIQAVIEAGLIAPLVNLLQNAEFDIKKEAAWALSNATSGGTHEQIKYLVSQGCIKPLCDLLVCPDPRIVTVCLEGLENILKIGEAEKSFGNAGDVNLYAQMIDEAEGLEKIENLQSHDNNEIYEKAVKILETYWLEDEDETLPPGDGSQPGFNFGGNDLPVPSGRNCVGCSRVLLALSPGGVGEGGRRSLYFMVSGVSLV

SEQ ID NO: 31 - DNA, 1605 bp, Oryza sativa
atgtcgctgcggccgagcgagcgggcggaggtgcggcggagcaggtacaaggtggcggtggacgcggacgaggggcggaggcggagggaggacaacatggtggagatccgcaagagccggcgcgaggagagcctcctgaagaagcgccgcgacggcctccccgccgccgccgcggccgccgcggcggcgtccccgctgctcgcccactcctccgcgctccagcagaagttggaggggttgccggcgatggtgcaggcggtgcagtccgacgacagcgccgtgcagctggaggccaccacgcagttccggaagctgctctccatcgagcggagtcctccaattgaggaggtgatcaacacaggggtggtgcctcgctttattgccttcctccaacgtgaggattatccccaactccagtttgaggctgcatgggcactcactaacattgcatcaggcacatcagataacaccaaagtggtagttgagtctggtgctgtgcccatctttgtcaaactgcttagctcccccagtgaggatgtccgtgagcaggctgtatgggctctgggaaatgtggctggtgactcaccaaaatgccgtgacctggtgcttgcaagtggtgggttatacccattgttgcaacagcttaatgagcacgccaagctctcaatgctcaggaatgccacatggacactgtcaaacttctgccgtgggaagcctcagcctaattttgagcaggtcaaaccagcgctttctgcactgcagcgcctcatccattctcaggacgaggaggtcctgactgatgcctgctgggctctttcttatttgtctgatggaactaatgataagatccaagctgtgatagaatcaggagtgttcccaaggcttgtggaacttctcatgcatccttcggcttcagtgctcattccagctttgcgcacggtgggtaacatcgtcactggggatgacatgcagactcagtgtgtcatcgatcatcaagctcttccatgtctcttgaacctcttgaccaacaatcataagaaaagcatcaagaaagaagcatgctggactatctcaaacatcactgctggcaatagggaacagattcaggctgtgatcaatgcaaacataattgctcctctagtacatctgctgcaaactgctgaatttgacatcaagaaagaggctgcgtgggcaatctcaaatgccacttctggtggaacacatgatcagattaagtaccttgttgcccagggttgcatcaagccactctgtgatctgcttgtttgcccagatcccaggatcgtgacagtttgcttggaaggtcttgagaacatcttgaaggttggagaggcagaaaagaaccttggggcaggggatgtcaattcctatgctcagatgattgatgatgctgagggactggagaagattgagaaccttcagagccatgacaacactgaaatatatgagaaggcagttaaaatgctcgagtcctactggttggaggaggaagatgatgccatgccctcaggtgacaacgctcaaaacggcttcaactttggaaaccagcagcccaatgttccatcgggtggattcaactttggctga

SEQ ID NO: 32 - protein, 534 aa, Oryza sativa
MSLRPSERAEVRRSRYKVAVDADEGRRRREDNMVEIRKSRREESLLKKRRDGLPAAAAAAAAASPLLAHSSALQQKLEGLPAMVQAVQSDDSAVQLEATTQFRKLLSIERSPPIEEVINTGVVPRFIAFLQREDYPQLQFEAAWALTNIASGTSDNTKVVVESGAVPIFVKLLSSPSEDVREQAVWALGNVAGDSPKCRDLVLASGGLYPLLQQLNEHAKLSMLRNATWTLSNFCRGKPQPNFEQVKPALSALQRLIHSQDEEVLTDACWALSYLSDGTNDKIQAVIESGVFPRLVELLMHPSASVLIPALRTVGNIVTGDDMQTQCVIDHQALPCLLNLLTNNHKKSIKKEACWTISNITAGNREQIQAVINANIIAPLVHLLQTAEFDIKKEAAWAISNATSGGTHDQIKYLVAQGCIKPLCDLLVCPDPRIVTVCLEGLENILKVGEAEKNLGAGDVNSYAQMIDDAEGLEKIENLQSHDNTEIYEKAVKMLESYWLEEEDDAMPSGDNAQNGFNFGNQQPNVPSGGFNFG

SEQ ID NO: 33 - DNA, 1605 bp, Physcomitrella patens
atgtctctccgtcccaacgcccgtgttgaggtccgcaagaagggtttcaagctggcaatcgatgccgatgaagcacgtagaaagagagaggacaacatggtggagattcggaagagcaagagagaggagagtcttctgaagaagcgtagagatggtatggttaaactgcagcagcagttcatgcccgccgcgcagactggcgctgccgagaagaagcaactggaaagcctccctgccatggttgctggagtttactctgacgaccccgcaacgcagttggaatcaaccacccaattcagaaagcttctctctattgagcgcagtccaccaatcgaagaggttatcgcagcaggtgttgtacctcggtttgtcgagtttctagtcaggaatgacttcccacagttgcagttcgaagctgcctgggcgttgacaaatattgcttccggaacttctgatcacacccgggtggttattgatcacggagctgtgccaattttcgttcagctcctgagttctccgagcgatgacgttcgagagcaggctgtatgggcattagggaatgtagcgggtgactctccaaagtgcagagatcttgttcttaaccatggcgctttgatgcctctgcttgctcagcttactgacaacacgaagttgtcaatgctgcggaatgcaacgtggaccctatccaacttttgtcgtggcaagcctcagccacctttcgagcagtccaagcctgcactcccagctttggagcgactcattcattcaaatgatgaagaagtccttacagatgcatgctgggccctatcttatttgtccgatggaacaaacgacaagatacaggctgtgattgaagctggtgtttgccgacgtctcgtggagctactgctcagccatccatcaccgtccgtgctaattcctgcactgcgcaccgtgggcaacatcgttactggtgacgaccttcagacccagttcatcatcaacaaccaggcccttccttgtctcctggctctcctgaccaacaatcacaagaaaagcattaagaaagaagcttgttggactatttcgaacataaccgcaggaaacaaggatcagattcaggccgtgattgacgcgaacattattccaccgcttgtatctttgctcgccactgctgagtttgacattaagaaagaagcagcttgggctatttcgaatgccacatccggtggaacgcacgatcaaatcaaatacctcgtcaaccagggttgtattaaaccactttgcgacttattgacctgcccagatccgagaattgtaaccgtctcccttgaaggtctggagaatatcttgaaggtcggagagcaggagaaagatcttggaaaaactggtgggatcaacgaatatgctcgctatattgatgaagccgagggcttagagaagattgagaacctccaaactcacgataacaatgaaatttacgagaaggctgtaaagatcttggagacgtactggttagaagaggatgaggagcagaatactgcacctggtacagatggtcaaagcttcgcgttcggttcaagtaatgtcgcaggagctcctcctggcgggttcaactttggctga

SEQ ID NO: 34 - protein, 534 aa, Physcomitrella patens
MSLRPNARVEVRKKGFKLAIDADEARRKREDNMVEIRKSKREESLLKKRRDGMVKLQQQFMPAAQTGAAEKKQLESLPAMVAGVYSDDPATQLESTTQFRKLLSIERSPPIEEVIAAGVVPRFVEFLVRNDFPQLQFEAAWALTNIASGTSDHTRVVIDHGAVPIFVQLLSSPSDDVREQAVWALGNVAGDSPKCRDLVLNHGALMPLLAQLTDNTKLSMLRNATWTLSNFCRGKPQPPFEQSKPALPALERLIHSNDEEVLTDACWALSYLSDGTNDKIQAVIEAGVCRRLVELLLSHPSPSVLIPALRTVGNIVTGDDLQTQFIINNQALPCLLALLTNNHKKSIKKEACWTISNITAGNKDQIQAVIDANIIPPLVSLLATAEFDIKKEAAWAISNATSGGTHDQIKYLVNQGCIKPLCDLLTCPDPRIVTVSLEGLENILKVGEQEKDLGKTGGINEYARYIDEAEGLEKIENLQTHDNNEIYEKAVKILETYWLEEDEEQNTAPGTDGQSFAFGSSNVAGAPPGGFNFG

SEQ ID NO: 35 - DNA, 1614 bp, Populus trichocarpa
atgtcgctgcgaccaggtacacgaacagaggtgaggaagaagtcgtacaagactggagtggatgcagatgaagcaagaaggaggagagaggacaatttactggagatcagaaagaataaaagagaagacaatcttttgaagaaaagaagagaaggtcttttgtttcagtctcaaagtcagcctttgcttgatgctgctcaacatgctgccaatatcgaaaaaaagttggagagtcttccgatgatggtccaaggagtgtggtctgatgatccttccttacagttggaagcaaccactcagtttagaaagcttttatctattgagcgcagtcctcctatagatgatgtaatcaaagcaggtgtggtcccgcggtttgtggaattccttggaaggcacgatctgcctcaactacaatttgaggctgcgtgggctttgactaatgttgcttctggaacatcagagcatacacgagttgtcattgaccatggtgctgttcctatgtttgtgcagcttcttagttctggaagtgatgatgtcagagagcaggcggtatgggccttgggcaatgttgcgggcgactccccaagttgcagggatcttgttcttggtcatggtgctctgatgccattgctagctcagctaaatgagaattcaaaattatccatgcttaggaatgctacctggacattatccaatttttgtcgtggcaagccaccaacaccatttgatcaggtgaagcctgctttgccagttctccagcaacttatccacttgaatgatgaagaagtcttaacagatgcatgctgggcactctcctatctttcagatggtcaaaacgacaaaattcaggctgtgattgatgctggtgtctgtcgacgtctggtggagcttcttcttcatccatcacctacagttcttattcctgcccttcgaacagttggaaacattgttacaggcgatgacggtcagactcagtttgtaattgacaatcaagtcctcccttgtctccaccaacttctcttgcaaaatcacaaaaaaagtatcaagaaagaagcgtgttggacaatctctaatatcacagctggaaatagaactcaaatacaggctgttattgaggccaatattattctccctcttgtaaaccttctgcaacatgcggagtttgacattaagaaggaggctgcctgggctatctcaaacgccacctctgcaggctctcatgaacaaattcaatttctggtgagccagggttgcattaaaccactgtgtgatcttcttatctgcccagaccccaggatcgtgacggtctgccttgaggggctggagaacatccttaaggtgggtgaggctgacaaggaaatgggcttaaatggtggagttaatctgtatgcgcaaatggttgatgaatgtgatggattggataagattgagaatctgcaaactcatgacaacaacgagatttatgaaaaggcagtgaagattttggagagatactgggctgaggaagaagatggagaaccgattgtccaagatggtggggatggaaatcagcaaggttttgcttttggaactaaccagcctagtgttccccaaggtggcttcaagtttgggtga

SEQ ID NO: 36 - protein, 537 aa, Populus trichocarpa
MSLRPGTRTEVRKKSYKTGVDADEARRRREDNLLEIRKNKREDNLLKKRREGLLFQSQSQPLLDAAQHAANIEKKLESLPMMVQGVWSDDPSLQLEATTQFRKLLSIERSPPIDDVIKAGVVPRFVEFLGRHDLPQLQFEAAWALTNVASGTSEHTRVVIDHGAVPMFVQLLSSGSDDVREQAVWALGNVAGDSPSCRDLVLGHGALMPLLAQLNENSKLSMLRNATWTLSNFCRGKPPTPFDQVKPALPVLQQLIHLNDEEVLTDACWALSYLSDGQNDKIQAVIDAGVCRRLVELLLHPSPTVLIPALRTVGNIVTGDDGQTQFVIDNQVLPCLHQLLLQNHKKSIKKEACWTISNITAGNRTQIQAVIEANIILPLVNLLQHAEFDIKKEAAWAISNATSAGSHEQIQFLVSQGCIKPLCDLLICPDPRIVTVCLEGLENILKVGEADKEMGLNGGVNLYAQMVDECDGLDKIENLQTHDNNEIYEKAVKILERYWAEEEDGEPIVQDGGDGNQQGFAFGTNQPSVPQGGFKFG

SEQ ID NO: 37 - DNA, 1590 bp, Solanum lycopersicum
atgtcgttgaggccgaacgccagaaccgaggttcgccggaaccgttacaaagttgccgttgatgccgaggaaggtcgccggagaagagaggacaatatggttgagattcgtaagaataagagagaggagaacttgcagaagaagcgacgtgaaggccttcaagctaatcagcaattttctgttcctgttcagtccactgtcgaaaagaagctcgagaatttaccagcaatggttgccggtgtttggactgaagatggcaatcttcagcttgaagctactactcagtttcgaaaactgctttccatagaaaggagtcccccaattgaggaggtaattcaagcaggtgttgttcctcggtttgttcaatttcttataagggatgactttccacaacttcagtttgaggcagcatgggctctcacaaatattgcttcggggacatctgaacataccaaggtggtgattgaatctggtgcagtcccaatttttgtgaaacttcttagttctccaagtgatgatgtgcgtgagcaggctgtttgggctcttggaaatgttgctggtgattccccaaaatgccgtgatcttgtccttaactgtggagctttgcttcccttgctgtctcagctgaatccaaatgccaagctctctatgttgagaaatgcaacctggacactttcaaatttctgcagaggcaaaccacagcctgcttttgatcagacgaagcctgcacttccagctcttcaacaactaattcattcaaccgatgaagaagttttgactgatgcttgctgggcactttcatatctctctgatggtacaaatgataaaattcaagctgttattgattctggagtatgcccacgattagtcgagttattacttcacccatctccatcggttttgattcctgctcttcggactgttgggaatattgtgacaggagatgatatgcaaactcagtgtatcatcggccatcaggctttgccctgtcttttgaacttgttgagtggtagtcacaagaagagtattaagaaggaagcttgctggacaatttctaacatcacggctggcaaccgggagcaaattcagtgtgtggttgacgctggtattataggtccccttgttaatttgctacaaaatgcggagtttgaaataaaaaaggaggctgcatgggcaatttcaaatgccacatctggtggttcacatgagcagatcaagtaccttgttagtcaaggttgtatcaagccattgtgtgatcttctcatttgtcctgacccaaggattgtcacagtttgtcttgaagggcttgaaaatattttgaaggttggggaagctgagaagagtttgggccggacatcagatataaatctttatgctcagctgattgatgacgctgaaggtttagaaaaaattgagaatcttcaaagccatgacaatcaagagatctatgaaaaggcagttaagattcttgagacgtactggttggaagaagatgacgagaccatgccacctggtgatgcagcccaacaaggttttcagtttggaggtggtgaggtttctgtgccctctggaggattcagctttaactaa

SEQ ID NO: 38 - protein, 529 aa, Solanum lycopersicum
MSLRPNARTEVRRNRYKVAVDAEEGRRRREDNMVEIRKNKREENLQKKRREGLQANQQFSVPVQSTVEKKLENLPAMVAGVWTEDGNLQLEATTQFRKLLSIERSPPIEEVIQAGVVPRFVQFLIRDDFPQLQFEAAWALTNIASGTSEHTKVVIESGAVPIFVKLLSSPSDDVREQAVWALGNVAGDSPKCRDLVLNCGALLPLLSQLNPNAKLSMLRNATWTLSNFCRGKPQPAFDQTKPALPALQQLIHSTDEEVLTDACWALSYLSDGTNDKIQAVIDSGVCPRLVELLLHPSPSVLIPALRTVGNIVTGDDMQTQCIIGHQALPCLLNLLSGSHKKSIKKEACWTISNITAGNREQIQCVVDAGIIGPLVNLLQNAEFEIKKEAAWAISNATSGGSHEQIKYLVSQGCIKPLCDLLICPDPRIVTVCLEGLENILKVGEAEKSLGRTSDINLYAQLIDDAEGLEKIENLQSHDNQEIYEKAVKILETYWLEEDDETMPPGDAAQQGFQFGGGEVSVPSGGFSFN

SEQ ID NO: 39 - DNA, 1230 bp, Triticum aestivum
atgtcgctgcggcccaacgagcgggccgaggtgcggcgcagccgctacaaggcgtccgtcgacgccgaggacgggcgccgccggcgggaggatcagatggtggagatccggaagaatcagcgcgacgcgaacctccagaagaagcgccgcgacgggttcccggccggcgccgcgtccgctgccggtggcgcgccgcagatgggccactcctcggctctccagcagaagctggagggcttgcccgcgatggtgcaggcggttctctcggacgacaacgccgtgcagctcgaggccaccacccagttccggaagctgctctccatcgagcgaagccctccaattgaggaagtgatcaacacaggcgtggtgcctcgcttcattgagttcctcacacgggaggactatccccaactccagtttgaggctgcatgggcgctcaccaacatcgcgtcaggcacatcagacaacaccaaagtggtggttgagtatggtgctgtgcccatctttgtcaagctactcagctctcctagtgaggatgtccgcgaacaggctgtttgggctctggggaatgttgctggtgactctccaaagtgccgtgaccttgtgcttggaagtggtggtctgttccctttgttgcagcagctcaatgagcatgccaagctctcgatgctcaggaatgccacatggacactctccaacttctgccgtgggaaaccacagccaaactttgaacaggtcaaaccggctctctcagcactgcagcgccttatccactctcaggatgaggaggtgctcactgatgcctgctgggctctctcgtacctgtctgatggaactaatgacaagatccaatccgtgattgagtctggtgtttttcctcgccttgtggagcttctcttgcacccttcggcttctgttctcattccagctctgcgcacggtgggtaacattgtcactggtgatgatttgcagactcagtgtgtcattgatcaccaagcacttccctgtctcttgaacctcttgactaccaaccacaagaaaagcatcaagaaagaagcatgctggacaatctcaaacatcacagctggtaaccgggaccagattcaggctgtcatccaggcaaacattattggtcctctggtccatctcctgcaaggtgctgaatttgacattagaaggaggcggcctgggcatttcaaatgccactctggtggacacatgaccagatag

SEQ ID NO: 40 - protein, 409 aa, Triticum aestivum
MSLRPNERAEVRRSRYKASVDAEDGRRRREDQMVEIRKNQRDANLQKKRRDGFPAGAASAAGGAPQMGHSSALQQKLEGLPAMVQAVLSDDNAVQLEATTQFRKLLSIERSPPIEEVINTGVVPRFIEFLTREDYPQLQFEAAWALTNIASGTSDNTKVVVEYGAVPIFVKLLSSPSEDVREQAVWALGNVAGDSPKCRDLVLGSGGLFPLLQQLNEHAKLSMLRNATWTLSNFCRGKPQPNFEQVKPALSALQRLIHSQDEEVLTDACWALSYLSDGTNDKIQSVIESGVFPRLVELLLHPSASVLIPALRTVGNIVTGDDLQTQCVIDHQALPCLLNLLTTNHKKSIKKEACWTISNITAGNRDQIQAVIQANIIGPLVHLLQGAEFDIRRRRPGHFKCHSGGHMTR

SEQ ID NO: 41 - DNA, 1584 bp, Zea mays
atgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaggcccaggtccctgcccctccctccggggttgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagccgcatgggctctcacaaatattgcttctggcacttcagaaaatacaaaggctgttattgaccatggggctgttcctatatttgtgaagcttcttgggtctggtagtgatgatgttcgtgagcaggctgtgtgggctttgggtaatgttgctggcgattctccgaagtgccgcgaccttgttctcgccaatggtgcgttgatgcctctgctagcccagttgaatgagcatgttaagctctccatgctgcggaatgccacctggactttgtctaacttctgcaggggaaaaccacagccatcatttgatcagactaagcctgctctgccagcacttgcacgacttatccattccaacgacgaggaagttctcactgatgcatgctgggccctgtcatacttatctgacggcactaatgataagatccaggctgtgattgaagctggtgtttgcccccggctcgtggagcttctcctccatccatcaccatcggtgcttatacctgctctacgaactgttgggaatattgtcactggagatgatttgcaaactcagtgtattattgatcatcaagctcttccccgcctcgtgaatctgttgacgcagaaccacaagaaaagcattaagaaagaggcatgctggactatttcaaatattactgctggaaacaaagatcagatacaggctgtcataagtgccggtatcatcgctcctttgttgcaactgcttcaaacagcagagtttgatatcaagaaggaggctgcttgggccatctcaaatgctacccctggtggttctcatgagcaaatcaagtacttggtgtctgagggctgcatcaagccattgtgtgaccttcttgtctgccctgatccgagaattgtaacagtttgtctggagggtcttgagaatattcttaaagtagggcagcatgacaagaccatgggtgcaacaggtgacactaatgtcttagctcagatgattgatgaagcggaaggcctggaaaagatcgagaacctacagagccacgataacaatgaaatctatgaaaaggctgtgaagcttcttgagacatactggatggaggaggaagatgacgcaatggctactgccggggaagctgctcctgctgtttttgactttaaccaaggtggcaaccctcctggtgctggtggtctgaacttcaactga

SEQ ID NO: 42 - protein, 527 aa, Zea mays
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKTGVVPRFVQSLTREDFPQLQFEAAWALTNIASGTSENTKAVIDHGAVPIFVKLLGSGSDDVREQAVWALGNVAGDSPKCRDLVLANGALMPLLAQLNEHVKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDLQTQCIIDHQALPRLVNLLTQNHKKSIKKEACWTISNITAGNKDQIQAVISAGIIAPLLQLLQTAEFDIKKEAAWAISNATPGGSHEQIKYLVSEGCIKPLCDLLVCPDPRIVTVCLEGLENILKVGQHDKTMGATGDTNVLAQMIDEAEGLEKIENLQSHDNNEIYEKAVKLLETYWMEEEDDAMATAGEAAPAVFDFNQGGNPPGAGGLNFN

SEQ ID NO: 43 - DNA, 1593 bp, Brassica napus
atgtctctgagacccaacgccaggaccgaggttcgccgtaaccgctacaaagtggcggtggacgcagaggaaggacgcaggaggagggaagacaacatggtggagatccgtaagaccaagcgcgaagagagcttactgaagaagcgtcgcgaggggcttcaagccacgcagctgcctcaagtcacttctgctgcttcatccgtcgagaaaaagttggagagcttgccttctatggtcggtggagtctggtcagatgataggagcttgcagcttgaagccactactcagttccgtaaattgctttctatagagcgtagtcctccgatagaagaggtgattgatgctggtgttgtgccaaggtttgtggagtttctcatgagggaggattatccacagcttcagtttgaagctgcttgggcactgacgaacattgcttctgggacttctgagcatacgaaggttgtcattcaacatgatgctgttcccatttttgttcagctcctggcttcccagagtgatgatgtccgtgagcaggctgtttgggcattagggaacgttgctggtgattctccacagtgcagagatcttgtactgagtaagggagctttgttaccattgctctctcagttgaatgagcatgctaaactctccatgctcagaaatgctacttggaccctctctaatttctgcaggggcaagccacagcctccttttgaccaggttcgtccagcacttccagcccttgagcgccttattcattcgactgatgaggaagtgttaacggatgcctgttgggctctctcttatctttctgatggcacaaatgacaaaatccaatctgtcatcgaggcaggtgttgttcctcgacttgtcgagcttctccagcatccgtcaccgtctgtgcttatacccgctcttcgtagtattggtaacatcgtcactggagacgatgcgcagacgcagtgtgtaattagtcatggtgcactcctttgtcttctgagtcttctgactcagaatcataagaagagcattaaaaaggaagcatgctggacaatctcaaacatcactgctggaaacagggaccagattcaggctgtatgtgaagctggtttgatcggtcctctcatcaatctgcttcaaaatgctgagttcgatataaagaaagaagctgcatgggcagtctcaaatgccacttcgggcggttctgctgaccagatcaagtacatggtggatcagggagtcgtgaaaccactgtgcgatcttttggtatgcccggatccaaggattatcaccgtgtgtctagaaggactagagaacattctgaaagtcggggaagctgagaaggtgacgggaaacacaggggatgcaaactattatgcacagctaatcgatgatgctgagggactagagaagattgagaatctgcagagtcatgacaacagcgagatatatgagaaggcagtgaagattcttgaaacatactggttggaggaggaagacgagactttaccacctggtgatgaatctgctcagggattccagtttgggggtagcgatgcagccgcacctccaggtggattcaacttcaagtga

SEQ ID NO: 44 - protein, 530 aa, Brassica napus
MSLRPNARTEVRRNRYKVAVDAEEGRRRREDNMVEIRKTKREESLLKKRREGLQATQLPQVTSAASSVEKKLESLPSMVGGVWSDDRSLQLEATTQFRKLLSIERSPPIEEVIDAGVVPRFVEFLMREDYPQLQFEAAWALTNIASGTSEHTKVVIQHDAVPIFVQLLASQSDDVREQAVWALGNVAGDSPQCRDLVLSKGALLPLLSQLNEHAKLSMLRNATWTLSNFCRGKPQPPFDQVRPALPALERLIHSTDEEVLTDACWALSYLSDGTNDKIQSVIEAGVVPRLVELLQHPSPSVLIPALRSIGNIVTGDDAQTQCVISHGALLCLLSLLTQNHKKSIKKEACWTISNITAGNRDQIQAVCEAGLIGPLINLLQNAEFDIKKEAAWAVSNATSGGSADQIKYMVDQGVVKPLCDLLVCPDPRIITVCLEGLENILKVGEAEKVTGNTGDANYYAQLIDDAEGLEKIENLQSHDNSEIYEKAVKILETYWLEEEDETLPPGDESAQGFQFGGSDAAAPPGGFNFK

SEQ ID NO: 45 - DNA, 957 bp, Gossypium hirsutum
  misc_feature (653)..(653): n is a, c, g, or t
  misc_feature (737)..(737): n is a, c, g, or t
atgtctcttagaccgagcgcgaggaccgaggttcgacggaaccgatacaaggtggcggttgatgcggaggaaggtcggcggaggagagaagacaacatggtggagatccggaagaacaagagagaagagaaccttctaaaaaagcgtcgcgaaggacttcttgctcaacaaccgcaaccgcagcaacagcagatgttatcttccggcgttggttccgagaataagttagaaagtcttccggctatggttgtgggcgtttggtctgatgacaagaatgcacagcttgaggcaaccactcaattccgaaagctgctatcaatagaacgtagtcctccaatcaatgaagttgtacaagcaggtgttgttcctcgctttgttgagttccttaatagggatgacttccctcagcttcagttcgaggcagcttgggctctcacaaatattgcttcaggaacatcagacaataccagagttgtaattgatcatggagctgtccctatatttgttaaactcctagattctccaacggatgacgtacgcgaacaggctgtttgggcattggggaatgttgctggagactctcctaaatgccgtgacctggtccttggccatgggggcttagtgcctcttttggcacaatttaatgagcatgncaagctctctatgttgcgaaatgctacctggactttgtcaaacttctgcaggggcaaggcacaaccttcgtttgagcagacaangccagcttttgcagctcttgagcggcttatcaattcaaatgatgaggaagtcttgacagatgcatgctgggctctgtcttatctctcagacggtactaatgacaaaatccaagctgttattgaagcagggggatgcccacaacttattgagctctttgctcctccatcccccacgggtcctcattcctgccctttcccaaagttgggaataattggttaa

SEQ ID NO: 46 - protein, 318 aa, Gossypium hirsutum
  misc_feature (218)..(218): Xaa can be any naturally occurring amino acid
  misc_feature (246)..(246): Xaa can be any naturally occurring amino acid
MSLRPSARTEVRRNRYKVAVDAEEGRRRREDNMVEIRKNKREENLLKKRREGLLAQQPQPQQQQMLSSGVGSENKLESLPAMVVGVWSDDKNAQLEATTQFRKLLSIERSPPINEVVQAGVVPRFVEFLNRDDFPQLQFEAAWALTNIASGTSDNTRVVIDHGAVPIFVKLLDSPTDDVREQAVWALGNVAGDSPKCRDLVLGHGGLVPLLAQFNEHXKLSMLRNATWTLSNFCRGKAQPSFEQTXPAFAALERLINSNDEEVLTDACWALSYLSDGTNDKIQAVIEAGGCPQLIELFAPPSPTGPHSCPFPKLGIIG

SEQ ID NO: 47 - DNA, 1593 bp, Glycine max
atgtcgctcaggccaaatgccagaaccgagattcgccgcaaccgttacaaggtcgccgtcgacgccgacgagggccgccggagaagagaggacaacatggtcgagatccgcaagagcaagcgcgaagagagtttgctcaagaagcgtcgtgaaggcctccaagctcagcaacagtttcccgctcctcttcagaactccaccgtcgacaagaagctggagagtcttcctgccatggttgctggagtttggtcggatgataatagtattcaacttgaagccactacgcaatttcgcaagctgctttcgattgaacggagccctccgattgaggaagttattcaagctggtgttgttccacgttttgttgagtttcttgttagagaggatttccctcaacttcagtttgaggctgcgtgggctctcacaaacattgcatctgggacttctgagaacactaaggtggtaattgatcatggggcagttcctatatttgtcaagctacttagttcacctagtgatgatgttcgggagcaggcagtgtgggctttgggaaatgttgctggtgactcccctaggtgtagagatctagtgctcagccaaggtgccctcgtcccactgttggcccagttgaatgagcatgcaaaactttcaatgctgagaaatgccacatggacattatctaacttttgcaggggtaagccacagcctccgtttgagcaggtgagaccggcacttccagcactcgagcgtttggttttttccaatgatgaagaagttttgacagatgcttgctgggcattatcatatctctctgatggcacaaatgacaaaatccaagcagttattgaggcaggtgtatgtgccagattggtgcagcttctcatacacccatctccctcagtgctgattcctgctcttcgtacagtgggaaatattgtgactggagatgatatgcagactcagtgtattatcaatcatggtgcactcccctgccttttgaacctgttgacaaataatcataaaaaaagcattaagaaagaagcttgttggactatatcaaacattactgctggaaataaagaacagatacagactgttattgaagctggtctggttgcaccccttgtcaatcttcttcaaaatgcggaatttgacattaaaaaggaagctgcttgggcaatctcaaatgctacatctggtggaattcatgagcagatcaagtacttggtgagtcagggttgcataaagcctctttgtgatcttcttgtttgcccagacccaagaattgttactgtctgtttagaaggcctagagaatattctgaaggttggagaagctgagaagagcctaggtaacactggagatgttaacgagtatgcacagatgatagatgatgctgagggattggagaagattgaaaacctacagagtcatgacaacaatgaaatatatgaaaaggctgttaaaattcttgaaacatattggttggaagaagaagatgagacactaccttcaggagatggtgctcaacctggtttcaatttcggaaacaatgagcttccagtcccatctggtggattcaacttcagctga

SEQ ID NO: 48 - protein, 530 aa, Glycine max
MSLRPNARTEIRRNRYKVAVDADEGRRRREDNMVEIRKSKREESLLKKRREGLQAQQQFPAPLQNSTVDKKLESLPAMVAGVWSDDNSIQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSQGALVPLLAQLNEHAKLSMLRNATWTLSNFCRGKPQPPFEQVRPALPALERLVFSNDEEVLTDACWALSYLSDGTNDKIQAVIEAGVCARLVQLLIHPSPSVLIPALRTVGNIVTGDDMQTQCIINHGALPCLLNLLTNNHKKSIKKEACWTISNITAGNKEQIQTVIEAGLVAPLVNLLQNAEFDIKKEAAWAISNATSGGIHEQIKYLVSQGCIKPLCDLLVCPDPRIVTVCLEGLENILKVGEAEKSLGNTGDVNEYAQMIDDAEGLEKIENLQSHDNNEIYEKAVKILETYWLEEEDETLPSGDGAQPGFNFGNNELPVPSGGFNFS

SEQ ID NO: 49 - DNA, 1575 bp, Hordeum vulgare; identical to SEQ ID NO: 27

SEQ ID NO: 50 - protein, 524 aa, Hordeum vulgare; identical to SEQ ID NO: 28

SEQ ID NO: 51 - DNA, 1686 bp, Medicago truncatula; identical to SEQ ID NO: 29

SEQ ID NO: 52 - protein, 561 aa, Medicago truncatula; identical to SEQ ID NO: 30

SEQ ID NO: 53 - DNA, 1581 bp, Oryza sativa
atgtcgctgcgcccgagcgagcgggtggaggtgcggcggaaccgctacaaggtggcggtggacgccgaggaggggaggcggcggcgcgaggacaacatggtggagatccgcaagagccgccgcgaggagagcctcctcaagaagcgccgcgaggggctccaggcccaggcccccgtccccgcctccgccgcaaccggcgtcgataagaagctcgaaagccttcctgctatgattggtggagtttattcggacgataacaaccttcagcttgaggccacaacacagttccgcaagttgctttctatagagaggagccctccaattgaagaggttattcaatcaggcgttgttcctagattcgtgcagtttcttaccagagaggatttcccccagctacagttcgaagctgcgtgggcacttacaaacattgcatctggcacttcggagaatacaaaggttgtcattgatcatggggctgtaccaatatttgtgaagcttcttggttcttctagtgatgatgttcgtgagcaggctgtatgggcattgggcaatgttgctggtgattcccctaagtgccgtgaccttgttcttgccaatggtgcattgctgcctctgctagcacagttgaatgagcacactaaactctctatgctaaggaatgcaacttggactttatcgaacttctgcagaggaaaaccacagccatcatttgaacagactaggcctgctcttccagcactggcacggcttattcactccaatgatgaggaagttctcactgatgcgtgctgggctctttcatatttatctgatggcactaatgacaagatccaagccgtgattgaagctggtgtttgcccccgtcttgtggagcttctcctccatccatcaccttcagtgcttatacccgcactacgaactgttggaaatattgtaactggagatgacgcgcaaactcagtgcatcattgatcatcaagccctcccttgcctcctaagtctgttgacacaaaatctcaagaaaagcatcaagaaagaggcttgctggactatttcaaatattactgctggtaacaaagatcagatacaggctgtcataaatgctggcattattggtcctctggtgaatctgctccaaacggcagagttcgatatcaagaaggaagctgcatgggccatctcaaatgctacttcaggcggtagccatgatcaaatcaagtatctggtgagcgagggctgcatcaagccattgtgtgatcttcttatttgcccagatataagaatcgttacagtttgtttggagggtctcgagaacattcttaaagtaggagaaaccgacaagaccttggctgcaggtgatgtgaatgtcttttcccagatgattgatgaagcggaaggtttggaaaagattgagaacttgcagagccatgataacaatgagatctatgaaaaagctgtgaagattcttgaggcctactggatggatgaggaggatgatacaatgggagctaccacggtagctgctccccaaggtgctacttttgactttggccaaggcggtggtgctgctcaattcaaataa

SEQ ID NO: 54 - protein, 526 aa, Oryza sativa
MSLRPSERVEVRRNRYKVAVDAEEGRRRREDNMVEIRKSRREESLLKKRREGLQAQAPVPASAATGVDKKLESLPAMIGGVYSDDNNLQLEATTQFRKLLSIERSPPIEEVIQSGVVPRFVQFLTREDFPQLQFEAAWALTNIASGTSENTKVVIDHGAVPIFVKLLGSSSDDVREQAVWALGNVAGDSPKCRDLVLANGALLPLLAQLNEHTKLSMLRNATWTLSNFCRGKPQPSFEQTRPALPALARLIHSNDEEVLTDACWALSYLSDGTNDKIQAVIEAGVCPRLVELLLHPSPSVLIPALRTVGNIVTGDDAQTQCIIDHQALPCLLSLLTQNLKKSIKKEACWTISNITAGNKDQIQAVINAGIIGPLVNLLQTAEFDIKKEAAWAISNATSGGSHDQIKYLVSEGCIKPLCDLLICPDIRIVTVCLEGLENILKVGETDKTLAAGDVNVFSQMIDEAEGLEKIENLQSHDNNEIYEKAVKILEAYWMDEEDDTMGATTVAAPQGATFDFGQGGGAAQFK

SEQ ID NO: 55 - DNA, 1599 bp, Physcomitrella patens
atgtctcttcgaccgaacgcccgagtggaaggtcgcaagaaggggtacaaactcgcggtcgatgccgatgaggcgcgcaggaagagggaggacaatatggtggagattcggaagagcaagagggaggagagtttattgaagaagcggagggatggtatgccgcagctgccgcagtttgtcccgtccgctcagagctctctgtctgacaagaagcaacttgagagccttccagcgttggtttctggtctttactctgacgatcctgctacccagttggaagcaaccacacaatttcgaaagcttctgtctatcgagcggagtcctcccattgaagaagtgatttccgctggtgtcgtcccccgtttcgtggagtttctagtcaggagcgattttccgcagttgcagttcgaggcggcatgggctttgacaaatattgcatcagggacttctgatcacacacgtgttgtcatcgaccatggtgctgttcccatctttgttcagctcctaagctctcccagtgacgatgtccgagaacaggctgtatgggctttgggaaacgttgctggtgattcgccgaaatgccgtgaccttgttttaggtcatggggccttgatgcctctgcttgcgcagcttacggagaacacaaaattgtctatgcttagaaacgctacctggactctctccaacttctgtcgtggcaagcctcaaccaccttttgagcagtcgaaaccagcgcttccggccttggagcggctcattcactcaaacgatgaagaggttctcacggatgcttgctgggcactatcttatttatccgatgggacgaatgacaagattcaggccgtgattgaggctggcgtctgtcgtcgacttgtggagttattgctccatccatcgccctctgtactcattcccgcgctgcgtactgttggcaacattgtgactggtgacgatcttcagacacagttcatcatcaataatcaggcccttccctgtcttcttgctcttctgaccaacaatcacaagaaaagtatcaagaaagaagcctgttggactatttccaatataactgcaggaaacaaggatcaaatccaggctgttattgatgccaacatcattccacctttggtatctcttcttgccaccgcagaatttgacatcaagaaggaagctgcttgggctatttcaaatgccacttctggtggcagtcacgatcagataaagtaccttgttacccaaggttgcattaagccactatgtgaccttctaacatgtccagatccgagaatcgtcactgtgtccctcgaagggctggaaaacattttgaaggttggggagcaggagaaagatcttggccagagtggtggtatcaacctttatgcccgctacatcgatgaagccgagggtttggagaagattgagaacttgcagacacacgataacaacgagatttatgaaaaggctgtgaagattctggagacttattggctagaagaggatgaggattcgaatgcggcacctggcacggaaggccaaaccttcgcgtttggttcaagcaacgctgcaggcgctcctgccggtggcttccactttggctaa

SEQ ID NO: 56 - protein, 532 aa, Physcomitrella patens
MSLRPNARVEGRKKGYKLAVDADEARRKREDNMVEIRKSKREESLLKKRRDGMPQLPQFVPSAQSSLSDKKQLESLPALVSGLYSDDPATQLEATTQFRKLLSIERSPPIEEVISAGVVPRFVEFLVRSDFPQLQFEAAWALTNIASGTSDHTRVVIDHGAVPIFVQLLSSPSDDVREQAVWALGNVAGDSPKCRDLVLGHGALMPLLAQLTENTKLSMLRNATWTLSNFCRGKPQPPFEQSKPALPALERLIHSNDEEVLTDACWALSYLSDGTNDKIQAVIEAGVCRRLVELLLHPSPSVLIPALRTVGNIVTGDDLQTQFIINNQALPCLLALLTNNHKKSIKKEACWTISNITAGNKDQIQAVIDANIIPPLVSLLATAEFDIKKEAAWAISNATSGGSHDQIKYLVTQGCIKPLCDLLTCPDPRIVTVSLEGLENILKVGEQEKDLGQSGGINLYARYIDEAEGLEKIENLQTHDNNEIYEKAVKILETYWLEEDEDSNAAPGTEGQTFAFGSSNAAGAPAGGFHFG

SEQ ID NO: 57 - DNA, 1590 bp, Populus trichocarpa
atgtcgttgagacctagcgcgagaaccgaggttcgccggaaccgatacaaagtcgcagtcgacgccgatgaaggtcgccggagaagagaggacaatatggtggagatccgcaagaacaagcgtgaagagagtttgctaaagaagcgacgcgaaggtctccaggcacaacagttccctcccgctattctctcttcttctaatgtggaaaagaagttagagaatttgccttcgatggtggctggtgtttggtctgaggatggcaatttgcagcttgaatcaactactcagtttcggaaactgctttcgattgagaggagtcctccgatagaggaagttatacaagctggggttgttcctcgatttgttgagtttcttgttagggaggatttccctcagcttcagtttgaggctgcttgggctctcacaaacattgcctctggaacttcagagaacactaaggtggtaattgatcatggtgcagttccaatatttgtcaagcttctcggttctcccagtgatgatgttagggagcaggctgtgtgggcattgggaaatgttgctggtgactcccctaagtgccgtgatcttgtgctcagccatggagccttgattccattgctggcacagttgaatgagcatgcaaagctttcaatgctgaggaatgctacgtggacactatcaaacttctgcaggggcaagccacagcctccgttcgagcaggtgaggccagcccttcctgcacttgaacgtcttgtacattcaactgatgaagaagtcctaactgattcttgctgggcactctcttatctttctgatggtacagatgataaaatccaagctgttattgaggcaggtgtctgtccacgacttgtggagctcctcctccatccttctccttcagtgcttgttcctgccctccgcacagttggaaatattgtgacaggggatgatatgcagacccagtgcataattaccactggtgcactcccatgccttctaagcctgctgactcataatcataaaaagagcatcaagaaagaagcttgctggactatctcaaacatcactgctggaaacaaggagcagatccaggctgttattgagaatggtttaattggcccgctcgttaatttacttcaaaatgcggagtttgatataaagaaagaagctgcttgggctgtgtctaatgctacttcgggtggcactcacgagcaaattaagtttttggtcagtcagggatgtattaaaccattgtgtgatcttcttgtatcccctgatccaaggattgtaactgtatctcttgaaggattagagaacattctgaaggttggggaagcggagaagaatttggggaatagtggagatgctaatttctatgcccagatgatagatgatgccgagggactagaaaagattgaaaatctacagagtcatgacaacaatgagatatatgagaaggcagtcaagattctcgagacttattggttggaagaagacgacgagactttgccttcaggtgatggtgcccagcaaggatttcagtttggtgggaacggtgttcaagttccatctggtggattcaacttttag

SEQ ID NO: 58 - protein, 529 aa, Populus trichocarpa
MSLRPSARTEVRRNRYKVAVDADEGRRRREDNMVEIRKNKREESLLKKRREGLQAQQFPPAILSSSNVEKKLENLPSMVAGVWSEDGNLQLESTTQFRKLLSIERSPPIEEVIQAGVVPRFVEFLVREDFPQLQFEAAWALTNIASGTSENTKVVIDHGAVPIFVKLLGSPSDDVREQAVWALGNVAGDSPKCRDLVLSHGALIPLLAQLNEHAKLSMLRNATWTLSNFCRGKPQPPFEQVRPALPALERLVHSTDEEVLTDSCWALSYLSDGTDDKIQAVIEAGVCPRLVELLLHPSPSVLVPALRTVGNIVTGDDMQTQCIITTGALPCLLSLLTHNHKKSIKKEACWTISNITAGNKEQIQAVIENGLIGPLVNLLQNAEFDIKKEAAWAVSNATSGGTHEQIKFLVSQGCIKPLCDLLVSPDPRIVTVSLEGLENILKVGEAEKNLGNSGDANFYAQMIDDAEGLEKIENLQSHDNNEIYEKAVKILETYWLEEDDETLPSGDGAQQGFQFGGNGVQVPSGGFNF

SEQ ID NO: 59 - DNA, 1590 bp, Solanum lycopersicum; identical to SEQ ID NO: 37

SEQ ID NO: 60 - protein, 529 aa, Solanum lycopersicum; identical to SEQ ID NO: 38

SEQ ID NO: 61 - DNA, 978 bp, Triticum aestivum
  misc_feature (885)..(885): n is a, c, g, or t
atgtcggtgcgtccgagcgagcgggccgacgcgcggcggaaccgctacaaggtgacggtggacgccgatgaggggcggcggcggcgcgaggacaacatggtggagatccgcaagaaccgccgcgaggagagcctcctcaagaagcgccgcgaggggctccaggcccaggctcctatccccgccgccggcgtcgagaagaagcttgaaagcttacctgctatggttggtggggtttattccgaggataacaacctgcagcttgaggcaacgacacaattccgcaagttgctttctatagaaaggagccccccaatcgaagaagttatccaatcaggcgttgttcctcgatttgtgcagtttcttactagagaggatttcccccaactccagtttgaagcagcgtgggcactcacaaacattgcgtctggcacatcagagaataccaaggttgtcattgatcatggggcagttccaatatttgtgaagcttcttgcatctggcagcgatgatgttcgtgagcaggctgtctgggcattgggcaatgttgctggtgactccccaaagtgccgcgaccttgtactcgcaaatggtgcattgatgcctctgctagcacagttgaatgagcatgctaaactctccatgttaaggaatgcgacctggactttatcaaatttctgcagaggaaagccacagccagcatttgatcagactaagcctgctctgccagcacttgcacgacttatccattccaatgatgaggaagttttaactgatgcatgctgggctctttcgtatctctctgatggcaccaatgacaagatccaatctgtgattgatgctggtgtctgtcctcggcttgtggagcttctcctccatcatcacctnaagggcttatactggcctagaactggtggaatatggtccagggagatactccaaaaccaggggttattgatcatcagctctggggtgtcctaa

SEQ ID NO: 62 - protein, 325 aa, Triticum aestivum
MSVRPSERADARRNRYKVTVDADEGRRRREDNMVEIRKNRREESLLKKRREGLQAQAPIPAAGVEKKLESLPAMVGGVYSEDNNLQLEATTQFRKLLSIERSPPIEEVIQSGVVPRFVQFLTREDFPQLQFEAAWALTNIASGTSENTKVVIDHGAVPIFVKLLASGSDDVREQAVWALGNVAGDSPKCRDLVLANGALMPLLAQLNEHAKLSMLRNATWTLSNFCRGKPQPAFDQTKPALPALARLIHSNDEEVLTDACWALSYLSDGTNDKIQSVIDAGVCPRLVELLLHHHLKGLYWPRTGGIWSREILQNQGLLIISSGVS

SEQ ID NO: 63 - DNA, 1470 bp, Zea mays
atgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgaggccaccacgcagttcaggaagctgctctccatagagcgtagtcccccaattgaagaggtgatcagcacaggagtcgtgccccgattcattgagttccttacacgtgaggaccatccacaactccagtttgaggctgcatgggcgctcaccaacattgcatcaggcacatcagagaacactaaggtggtggttgagagtggtgctgtgcccatctttgttaagctcctcaactccaatagcgaggatgttcgtgaacaggctgtatgggctttaggtaatgttgctggtgactccccaaagtgccgtgatctggtgctaggccatggtgggctattccccttgctgcaacagcttaatgagcatgctaagctctcgatgctgaggaatgccacatggacactatcaaacttctgccgtgggaagccacaaccgaactttgatcaggtcaaaccagcattgccagcacttcagcaacttatccactctcaggatgaggaggtcctaactgatgcctgttgggctctatcatacctatctgatgggactaatgacaaaatccaagctgttattgaatctggcgtgttccctcgccttgtggaacttctgatgcatccttcagcctctgtactgattccagctctgcgcacggtgggtaacatcgtaactggggacgacatgcagactcagtgtgtcattgacaatcaagcacttccatgccttttgaacctactgaccaccaaccacaagaaaagcatcaagaaagaagcatgctggacaatctcaaacatcacagctggtaacagggaacagattcaggccgtgattaatgcaaacataattgcacctctggtgcaacttctgcaaactgctgaatttgacatcaagaaagaagcagcctgggcaatttcaaatgccacttctggtggcacacatgatcagatcaagtaccttgttgcccagggttgcattaagccactctgtgatctgcttgtttgcccggatcccagaatcgtaacagtttgcttggagggtctcgagaacatcctgaaagttggcgaggcagagaaaaaccttggtgcaggcgatgtcaatgtctacgcacagatgattgatgatgctgagggcctggacaagattgagaactgcagagccatgacaacaccgagatatatgagaaggctgtcaagatgctga

SEQ ID NO: 64 - protein, 489 aa, Zea mays
MSLRPSEREQMRKGNYKQTVDAEESRRRREGQMVDIRKAKREESLQKKRRDGFPAAGAVPPMGHSTALQQKLDGLPAMVQAVHSNDPTVQLEATTQFRKLLSIERSPPIEEVISTGVVPRFIEFLTREDHPQLQFEAAWALTNIASGTSENTKVVVESGAVPIFVKLLNSNSEDVREQAVWALGNVAGDSPKCRDLVLGHGGLFPLLQQLNEHAKLSMLRNATWTLSNFCRGKPQPNFDQVKPALPALQQLIHSQDEEVLTDACWALSYLSDGTNDKIQAVIESGVFPRLVELLMHPSASVLIPALRTVGNIVTGDDMQTQCVIDNQALPCLLNLLTTNHKKSIKKEACWTISNITAGNREQIQAVINANIIAPLVQLLQTAEFDIKKEAAWAISNATSGGTHDQIKYLVAQGCIKPLCDLLVCPDPRIVTVCLEGLENILKVGEAEKNLGAGDVNVYAQMIDDAEGLDKIENCRAMTTPRYMRRLSRC

SEQ ID NO: 65 - DNA, 1593 bp, Brassica napus; identical to SEQ ID NO: 43

SEQ ID NO: 66 - protein, 530 aa, Brassica napus; identical to SEQ ID NO: 44

SEQ ID NO: 67 - DNA, 1596 bp, Glycine max
atgtcgctgaggccgaatgctagaaccgaggttcgccgcaaccgctacaaggtggcggtggacgccgacgagggtcgccggcggagggaggacaacatggttgagatccgcaagagcaagcgcgaagagagcctccagaagaagcgccgcgaaggcctccaagctcagcagcagttccccactcctctccaagcctcctccattgtcgagaaaaagttagagagtcttcctgcgatggtagctggagtgtggtcggatgataacagccagcaattggaagcgaccacgcagttccggaaactgctttcgattgagcgcagtcctccgattgaggaagttattcaagctggggttgtgcctcggtttgtggagtttcttgttagggaggattttcctcaactacagtttgaggctgcgtgggctctcacgaacattgcatctggaacttctgagaataccaaggtggtgattgatcatggggcggtgccgatatttgtcaaactacttagttcgcccagtgatgatgttcgggagcaggcagtatgggcgttgggaaatgttgctggtgactccccaaggtgtcgtgatcttgttcttagtcacggtgccctgatcccattgttggcccagttgaatgagcatgcaaaactttccatgttgagaaacgccacatggaccctttcaaacttctgcaggggcaagccacagcctccatttgagcaggtgagggcagcgcttcctgctctagaacgattggttttttccaatgatgaagaagtcttgacagatgcatgctgggcgctatcatatctttccgatggaacaaatgacaaaatccaagccgttattgaggctggtgtttgtcccagactggtgcagctccttctgcacccatccccttcagtgctgattcctgctcttcgcacagttggaaatattgtgacgggagatgatatgcagactcagactatcatcaatcatggtgcgctcccatgcctcttgagcctgttgacacacaatcataaaaaaagtatcaagaaagaagcatgctggaccatatcaaacattacggctggaaacagagatcagatacaggctgttattgaagctggtctgattgccccccttgtcaatcttcttcaaaatgctgaatttgacataaaaaaagaagctgcttgggcaatctcaaatgctacatctggcggtacccatgagcagatcaagtatttggtgagccagggttgcatcaagcctctctgtgatctgcttgtttgccccgacccaagaattgtcactgtctgtttagaaggtcttgagaatattctgaaggttggggaagctgagaagagcttgggtaatactggagatgtcaacttgtatgctcagatgatagacgaagcagagggattagagaaaattgaaaacctgcagagtcatgacaacaatgaaatatatgaaaaggctgttaaaattcttgagacatactggttggaagacgatgatgagacactacctgcaggcgatggtgctcaacccggttttaattttggaaacaatgatcttccggttccatctggtggattcaactttagttga

SEQ ID NO: 68 - protein, 531 aa, Glycine max
MSLRPNARTEVRRNRYKVAVDADEGRRRREDNMVEIRKSKREESLQKKRREGLQAQQQFPTPLQASSIVEKKLESLPAMVAGVWSDDNSQQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSHGALIPLLAQLNEHAKLSMLRNATWTLSNFCRGKPQPPFEQVRAALPALERLVFSNDEEVLTDACWALSYLSDGTNDKIQAVIEAGVCPRLVQLLLHPSPSVLIPALRTVGNIVTGDDMQTQTIINHGALPCLLSLLTHNHKKSIKKEACWTISNITAGNRDQIQAVIEAGLIAPLVNLLQNAEFDIKKEAAWAISNATSGGTHEQIKYLVSQGCIKPLCDLLVCPDPRIVTVCLEGLENILKVGEAEKSLGNTGDVNLYAQMIDEAEGLEKIENLQSHDNNEIYEKAVKILETYWLEDDDETLPAGDGAQPGFNFGNNDLPVPSGGFNFS

SEQ ID NO: 69 - DNA, 957 bp, Gossypium hirsutum; identical to SEQ ID NO: 45
  misc_feature (653)..(653): n is a, c, g, or t
  misc_feature (737)..(737): n is a, c, g, or t

SEQ ID NO: 70 - protein, 318 aa, Gossypium hirsutum; identical to SEQ ID NO: 46
  misc_feature (218)..(218): Xaa can be any naturally occurring amino acid
  misc_feature (246)..(246): Xaa can be any naturally occurring amino acid

SEQ ID NO: 71 - DNA, 1575 bp, Hordeum vulgare; identical to SEQ ID NO: 27

SEQ ID NO: 72 - protein, 524 aa, Hordeum vulgare; identical to SEQ ID NO: 28

SEQ ID NO: 73 - DNA, 1686 bp, Medicago truncatula; identical to SEQ ID NO: 29

SEQ ID NO: 74 - protein, 561 aa, Medicago truncatula; identical to SEQ ID NO: 30

SEQ ID NO: 75 - DNA, 1581 bp, Oryza sativa; identical to SEQ ID NO: 53

SEQ ID NO: 76 - protein, 526 aa, Oryza sativa; identical to SEQ ID NO: 54

SEQ ID NO: 77 - DNA, 1599 bp, Physcomitrella patens; identical to SEQ ID NO: 55

SEQ ID NO: 78 - protein, 532 aa, Physcomitrella patens; identical to SEQ ID NO: 56

SEQ ID NO: 79 - DNA, 1590 bp, Populus trichocarpa; identical to SEQ ID NO: 57

SEQ ID NO: 80 - protein, 529 aa, Populus trichocarpa; identical to SEQ ID NO: 58

SEQ ID NO: 81 - DNA, 1590 bp, Solanum lycopersicum; identical to SEQ ID NO: 37

SEQ ID NO: 82 - protein, 529 aa, Solanum lycopersicum; identical to SEQ ID NO: 38

SEQ ID NO: 83 - DNA, 978 bp, Triticum aestivum; identical to SEQ ID NO: 61
  misc_feature (885)..(885): n is a, c, g, or t

SEQ ID NO: 84 - protein, 325 aa, Triticum aestivum; identical to SEQ ID NO: 62

SEQ ID NO: 85 - DNA, 963 bp, Zea mays
atgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaggcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagctgcatgggctctcacaaatattgcttctggcacttcagaaaatacaaaggttgttattgatcatggagctgttcctatatttgtgaagcttcttgggtctggtagtgatgatgttcgtgagcaggctgtgtgggctttgggtaatgttgctggcgattctccgaagtgccgcgaccttgttcttgccaatggtgcgttgatgcctctgctagcccagttgaatgagcatgctaagctctccatgctgcggaatgccacctggactttgtctaacttctgcaggggaaaaccacagccatcatttgatcagactaagcctgctctgccagcacttgcacgacttatccattccaacgacgaggaagttctcactgatgcatgctgggccctgtcatacttatctgacggcactaatgataagatccaggctgtgattgaagctggtgtttgcccccggcttgtggagctcctcctccatccatcaccatcggtgcttatacctgctctacgaactgttgggaacattgtaactggagatgatcagcaaactcaggtggggctttaa

SEQ ID NO: 86 - protein, 320 aa, Zea mays
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKTGVVPRFVQSLTREDFPQLQFEAAWALTNIASGTSENTKVVIDHGAVPIFVKLLGSGSDDVREQAVWALGNVAGDSPKCRDLVLANGALMPLLAQLNEHAKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDQQTQVGL

SEQ ID NO: 87 - DNA, 2616 bp, Arabidopsis thaliana
atggctatggagatcacacagttccttctggctgcccagtcagccgatgcaagagtccgtactgaagcagaggctagtctcagacagttccaagaacaaaacttgccgctgttcttgttatccttgtcttttgagcttgaaaacaatgataaacctgctgaatcccgtcgactagccggtattctgctaaagaattctctggacgccaaagattctgccacaaaagatcatctggtgaaacaatggtttgcaattgatgttgctcttaaatcccagatcaaggatcgcttactaagaactcttggttcatctgccctagaggcaaggcatacttcagctcaggttattgctaaggtagcctccattgaaattcctcagaagcagtggcctgaacttgttggatcgctgcttaacaatatgactcagcaaggcagtcccgcacacttgaagcaatcaaccttggaaactctaggctatgtctgtgaagagatatcacaccatgatcttgtgcaagatgaagtgaattctgtcctcacagcagttgtgcagggcatgaaccagtctgaaaatactgctgaagttcgtctcgcagcaacaaaggcactgttaaatgccttggatttctctcagacaaattttgagaatgaaatggagaggaattacatcatgaagatggtatgcgagacagcatgttccaaggaggcagagatcaggcaagctgctttcgagtgccttgtgtccattgcatccacatactatgaggtgctggagcactacatacaaacactctttgagctcacatcgaatgctgtaaagggagatgaagagagcgttgccctccaagcaattgagttctggagttccatctgtgatgaagagatcgaccgtcaagagtatgacagtcctgatagtggtgactcatcccctccccactcctgtttcatagagaaggctcttccccatttagttcaaatgttgctagaaactctgctgaagcaggaagaggatcaggaccatgacgacgatgtctggaacatatctatggctggcgggacatgccttggcctggttgctagaacggttggagatggtgtagtccctcttgtgatgccttttgttgaaaaaaacataagttcgccagattggcgaagccgggaggcagccacttatgcttttggatcaattttggagggcccaacaattgataagcttgccccgatggtagctgctggcttggaatttctccttaatgcaaccaaggatcagaataaccatgtcagggatacaactgcttggactctgagccgtatctttgaatttttgccatccccagacagtggcttctctgttatatcacccgaaaacctccctagaattgtgagtgtattactggaatcaattaaagatgtgccaaatgttgcagagaaggtctgtggagcaatatacaatcttgcacagggatatgaagactctggagcaagttcctctcttctctctccttatcttacagagatcatcacacatctccttgcagctgctgagcgtacagatggggcagagtctaagctaagaggtgctgcgtatgaaaccttgaacgaggttgtccggtgttcaaacctttcagaggcctcaagcatcatagcgcatctcctccctgccatcatgaaaaaattagctgagacaatggacctccctataatatcaactgatgaccgtgagaagcaagcggaactccaggcgtctctgtgcggtgttctccaagtcataatccagaagctgagcagcagggacgatatgaaacctatcatagtgcaaaacgcagatgacatcatgaggttattcctaagagtgtttggttgccatagttcaagtgtccacgaagaagccatgcttgcaatcggtgctcttgcctatgcgactggaactgagtttgtgaaatacatgcccgagctttttaaatatctccagatggggctgcagaatttcgaagaataccaagtctgctcaatcaccgtaggagtgattggtgacatatgccgtgcgctggatgaaaaaatcctacccttttgcgatcagataatgggtctccttatccaaaaccttcaaagtggtgcactccacagatcggtgaagcctccaatcttctcatgctttggagacattgctctggcgattggtgctcattttgaaaggtatgtagctccagctgttcagataatgcaaggtgctgctcaggtgtgtgcgcagatggacacccttgacgaggagcttatggattatgcaaaccaactccggagaagcatctttgaagcatactccgggatactgcaagggttcaaggatgcaaaggctgagctcatgatgccctatgctcaacatctgttgcagtttgttgaactagtatccaaagattccctgagggatgagagcgtgacaaaagccgcggttgcagcaatgggtgatcttgcggatgttgtaggggagaacacgaagcagttgttccaaaacttcaccttctgtgatgagttcctcaatgagtgtctcgaatcagaggatgaagatctcaaggtcactgcacgctggactcaaggaatgatcgcaagactcgtgctctaa

SEQ ID NO: 88 - protein, 871 aa, Arabidopsis thaliana; identical to SEQ ID NO: 20

SEQ ID NO: 89 - DNA, 2622 bp, Arabidopsis thaliana
atggcgatggagatcacacagtttctgttggctgcccagtcagccgatgcaagagtccggactgaagcagagggtaatctcaggcaattccaagaacagaacttgccgctgttcttagtatccttgtcttttgagcttgccaacaatgataaacctgctgaatcccgtcgactagccggtattctgctaaagaattctctggacgccaaagattctgccacaaaagatcatctggtgaaacaatggtttgcaattgatgttgctcttaaatcccagatcaaggatcgcttactaagaactcttggttcatctgccctagaggcaaggcatacttcagctcaggttattgctaaggtagcctccattgaaattcctcagaagcagtggcctgaacttgttggatcgctgcttaacaatatgactcagcaaggcagtcccgcacacttgaagcaatcaaccttggaaactctaggctatgtctgtgaagagatatcacaccatgatcttgtgcaagatgaagtgaattctgtcctcacagcagttgtgcagggcatgaaccagtctgaaaatactgctgaagttcgtctcgcagcaacaaaggcactgtgtaatgccttggatttctctcagacaaattttgagaatgaaatggagaggaattacatcatgaagatggtatgcgagacagcatgttccaaggaggcagagatcaggcaagctgctttcgagtgccttgtgtccattgcatccacatactatgaggtgctggagcactacatacaaacactctttgagctcacatcgaatgctgtaaagggagatgaagagagcgtttccctccaagcaattgagttctggagttccatctgtgatgaagagatcgaccgtcaagagtatgacagtcctgctagtggtgactcatctcctccccactcctctttcatagagaaggctcttccccatttagttcaaatgttgctagaaactctgctgaagcaggaagaggatcaggaccatgatgacgacgtctggaacatatctatggctggcgggacatgccttggcctggttgccagaacagttggagatcatgtagtccctcttgtgatgccttttgttgaaaaaaacataagttcgccagattggcgctgccgggaggcagccacttatgcttttggatcaattttggagggcccaacaattgataagcttgccccgatggttgctgctggcttggaatttctccttaatgcaaccaaggatcagaataaccatgtcagggatacaactgcttggactctgagccgtatctttgaatttttgcactccccagacagtggtttctctgttatatcacccgaaaacctccctagaattgtgagtgtattactggaatcaattaaagatgtgccaaatgttgcagagaaggtctgtggagcaatatacaatcttgcacagggatatgaagactctggagcaagttcatctcttctctctccttatcttacagagatcatcacacatctgcttgcagctgctgagcgtacagatggggcagagtctaagctaagaggtgctgcgtatgaaaccttgaacgaggttgtccggtgttcaaacctttcagaggcctcaagcatcatagcgcatctcctccctgccatcatgaaaaaattagctgagacaatggacctccctataatatcaactgatgaccgtgagaagcaagcggaagtccaggcttctctgtgtggtgttctccaagttataatccagaagctgagcggcagggaggatacgaaacccatcataatgcagagcgcagatgacattatgaggctgttcctaagagtgtttggatgccatagttcaagtgtccacgaagaagccatgcttgcaatcggtgctcttgcatatgctactggagctgagtttgtgaaatacatgcccgagcttttcaaatatctccagatggggctgcagaatttcgaagaataccaagtctgctcaatcacagtaggagtgcttggtgacatttgccgtgccctggatgaaaaaatcctacctttttgcgatcagataatgggtctccttatccaaaaccttcaaagtggggcactccacagatcagtgaagcctccaatattctcatgctttggagacattgctctggcaattggtgctcattttgaaaggtatgtagcaccagccgttcagatcatgcaaggggctgctcaggtgtgtgctcagatggatacccttgacgaggagcttatggattatgcaaaccaactgcggagaagcatctttgaggcatactccgggatactacaagggttcaaggacacaaaagccgagctcatgatgccctacgctcaacatctcctgcagtttgttgaactagtatccaaagatcccctgagggatgagagcgtgacaaaagccgcggttgcagcgatgggtgatcttgcggatgttgtaggagagaacacaaagcagttgttccaaaacttcaccttcttcggtgagttccttaatgagtgtctcgaatcagaggatgaagatctcaaggtcactgcacgctggactcaaggaatgattgcaaggctcatgcacccatcataa

SEQ ID NO: 90 - protein, 873 aa, Arabidopsis thaliana; identical to SEQ ID NO: 18

SEQ ID NO: 91 - DNA, 2289 bp, Glycine max
atggcaatggaagttacccaggtgcttttgagtgctcaatcaattgacgggaatgtacggaagcatgctgaggacagtctccgacaatttcaggagcaaaaccttcctggattcttggtctctctctctggagagttagcaagtgaagataaaccggttgatagccgaaagttggcgggtttgatactgaaaaatgctttggatgccaaggatgaaaacagaaagcaggaattggtccaaagatggttgtcgctggaccctgtggcaaagactcaagttaagtcatgcttgctgcaaacactctcttctcttgtacctgatgctcggtctacagcaactcaagttattgctaaagttgctggaattgagcttcctcagaaacagtggcctgagctgataggatcacttttatcaaatattcatcaagttcctactcatgtcaagcaagcgactttggagaccctggggtatttgtgtgaggaggtatctcctcaggttgttgatcaagaccaagtaaataaaatacttactgccgtagttcaaggtatgaatgcgtctgaagggaacaatgatgttaggcttgctgctacaagggcattatataacgctcttgggtttgctcaagctaattttagcaatgatatggagcgtgattatatcatgagagttgtttgtgagacaactgtgtgccctgaactgaaaatacgtcaagcagcctttgaatgtttggtctcaattgcagccatgtattatgagaaattggctccttacatccaggatatatataacatcacagcaaaggctgttagggttgatgaggaacctgttgctcttcaagccattgaattttggagtacaatttgtgatgaggagactgatatcttagaagaatatatgggtgattccaatggagactccgatataccttgtttttatttcatcaagcaagctcttcctgcacttatccctctgctgttggaaacattactcaaacaagaagaggatcaggatctggacgaaggtgcatggaatattgcaatggcaggtggtacatgccttggtttagttgcccgtactgttggagatgatattgtgccgctggtaatgcccttcattgaggagaatatcacaaaaccagattggaggcaaagggaggcagcctcttatgcttttggatctatcttggaggggccttcacctgacaaattagctcctcttgttaaccatgccttaccatttatgcttagtgctttagtgaaggacccaaacaaccatgtgaaagacaccactgcttggactttgggacgaatgttcgaatttcttcacagttcaattgttggtacaccaatcattaatgagggaaattgccaacagattattacagttctccttcaaagcatgaaggatgttcccaatgttgctgagaaggcctgtggtgctctgtattttcttgcccagggttatgaggatgttggaccaacatctccgctaactcccttgtttcaggaaattgttcaatcccttctaactgttacccacagagaggatgctacagaatctcgattgagaactgcggcatatgaaacattgaatgaagtagtaaggtgttcaacagatgaaacagctactttggtggtacaactagtttctgtcatcatgatggagctgcacaaatgtcttgaagcacaaaatctttcatcggatgagagagaaaagcggagtgaattgataggccttctttgtgggtgcatgcaagtaattattcagaaactagggtctttggattctaccaaatatgtgttggtgcagtattctgatcagataatgagactattcttcagggtctttgcttgtagaaatgccactgcacacgaggaggcaatgctagccattggagcccttgcctactcaataggccaggagttttccaattacatgccagaattttacaagtttctcgagatggaccttcagaactttgaggagtaccaagtttgtgctgtcactgttggtgtcataggggacatatgcagggcattggagttaaaaatactgccttattgtgatgggattatgacacaactcctcaagaatttgtcaagtgataatttgcaccgttctgtgaagccccctttattctcatgcattggtgatattgcacttgcaataggagataacttcaataaatacttaatgtatgcaatgaacacactacaacttgctgcagagatgtatgcccacacgtcaggttttgatgatgaaatgacaggagtatatcaaattctttga

SEQ ID NO: 92 - protein, 762 aa, Glycine max
MAMEVTQVLLSAQSIDGNVRKHAEDSLRQFQEQNLPGFLVSLSGELASEDKPVDSRKLAGLILKNALDAKDENRKQELVQRWLSLDPVAKTQVKSCLLQTLSSLVPDARSTATQVIAKVAGIELPQKQWPELIGSLLSNIHQVPTHVKQATLETLGYLCEEVSPQVVDQDQVNKILTAVVQGMNASEGNNDVRLAATRALYNALGFAQANFSNDMERDYIMRVVCETTVCPELKIRQAAFECLVSIAAMYYEKLAPYIQDIYNITAKAVRVDEEPVALQAIEFWSTICDEETDILEEYMGDSNGDSDIPCFYFIKQALPALIPLLLETLLKQEEDQDLDEGAWNIAMAGGTCLGLVARTVGDDIVPLVMPFIEENITKPDWRQREAASYAFGSILEGPSPDKLAPLVNHALPFMLSALVKDPNNHVKDTTAWTLGRMFEFLHSSIVGTPIINEGNCQQIITVLLQSMKDVPNVAEKACGALYFLAQGYEDVGPTSPLTPLFQEIVQSLLTVTHREDATESRLRTAAYETLNEVVRCSTDETATLVVQLVSVIMMELHKCLEAQNLSSDEREKRSELIGLLCGCMQVIIQKLGSLDSTKYVLVQYSDQIMRLFFRVFACRNATAHEEAMLAIGALAYSIGQEFSNYMPEFYKFLEMDLQNFEEYQVCAVTVGVIGDICRALELKILPYCDGIMTQLLKNLSSDNLHRSVKPPLFSCIGDIALAIGDNFNKYLMYAMNTLQLAAEMYAHTSGFDDEMTGVYQIL

SEQ ID NO: 93 - DNA, 2613 bp, Glycine max
atggccatggaggttactcaaatccttttaaacgcgcaagcagtcgatggcacattaaggaaacaagccgaggaaagcttgaaacaatttcaggaacagaatcttccaagtttcttgttttctcttgctggggaactggcaaatgacgacaagcctgcagagagtcgcaagctagcaggtttaattctgaagaatgctctggatgctaaagagcagcacagaaaaatagaatttgttcaaagatggttgtcattggacccaactttgaaatcccagattaaggcattcttgttaaggacactttcttctccttctcttgatgcccggtcaactgcatcacaggttattgctaaagttgctggcattgagttgcctcataaacagtggcctgaattgataggatccctcttgtctaatgctcatcagcttcctgcccctacaagacaggcaacacttgagacccttggttacatctgtgaagaagtttcccctgatgtagtagaccaggatcatgtaaataagatactcactgctgttgttcaagggatgaattcaacagaagaaaacaatgatgtcaggcttgctgccataaaagcattgtacaatgcattgggttttgctcaggcgaatttttctaatgacatggagcgggattatatcatgagaattgtgtgtgagacaacacaatctcctgaattgaagattcgacgagcagcttttgagtgcttggtagctatttcttcgacatactatgaaaagttagctccttatatccaagatatcttcaacatcactgccaaggctgtgagggaagatgaggagccggttgcacttcaggcaattgagttttggagttcaatatgtgacgaagaaattgatatactagaagaatatggtggtgattttagtggggattcagaggttccctgcttttattttattaaacaggcactttcatttcttgtccccatgttattggagacactgctgaagcaagaagaagatcaagaccaggatgaaggagcatggaacattgctatggctggaggtacctgcttgggattagttgcacggacagttggtgatgacattgtacctttggttatgccgtttattgaagagaatataaccaaaccagattggaggcaaagggaagctgcaacttatgcctttggctctattttagaaggtccctcccctgataaacttgtgccactggtgaatatggctttgaatttcatgctcactgcattgatgaaagatccaaataatcacgtgaaggacacaactgcatggactctagggcgaatgttcgaatttttgcatggatcagctctggatactccgattattactccagcaaactgccaacagattattactgtgctgcttcagagcatgaaggatgttccaaatgttgctgagaaggcttgtggtgctctttattttcttgcccaaggctatgaggatgctgcatctgcgtcctctccattgacccccttctttcaagatattgttcatgctcttctcactgtaactcacagagaggatgctggagaatcccgccttagaacagcagcctatgaagccttaaatgaagtagtgaggtgttctaatgatgaaacagctcctatggtggtacaacttgttcctctcatcatgatggagctccatcagactcttgagaatcagaaggtttcatctgacgagaggcagaatgagttacaaggccttctatgtggttgcttgcaggttatcatacagaagttaggatcatctgaaccaacaaagtatcatttcatgcagtatgctgaccaaataatgggtttatttttgagagtgtttgcttctcgaagtgcaacagctcatgaggaggctatgcttgccattggagctttggcctatgcaactggtgctgattttgcgaaatacatgacagaattttacaagtacttggagatgggtctccaaaattttgaggactaccaggtatgtgctatcacagtgggtgtggttggtgatgtatgcagagccttggaggagaaagtactgccttattgtgatgggataatgacccaacttcttaaggatttgtccagcaatcagctgcataggtctgttaagcctcctattttttcatgttttggagacatagccttggcaattggagaaaactttgagaagtacttgttatatgcaatgcctatgcttcagagtgctgcagaactctctgctcatacatctggtgctgatgatgatatgacagaatacacaaattctttgagaaatggaattctagaggcatactcagggatcttccaaggatttaaaggttccccaaagacccagcttctgatgtcttatgctcctcatgtgctgcaattcttggatagtttgtatatggagaaggacatggatgatgttgtgactaagacagcaattggcgtgcttggagatttagctgatactttgggcagtagtgctggccccttgattcagcaatctgtgtctagcaaagacttcctcaaagagtgtttatcatctgatgaccatttgattaaggaatctgccgaatgggccaagttggcaatcagtcgagcaatttcattttga

SEQ ID NO: 94 - protein, 870 aa, Glycine max
MAMEVTQILLNAQAVDGTLRKQAEESLKQFQEQNLPSFLFSLAGELANDDKPAESRKLAGLILKNALDAKEQHRKIEFVQRWLSLDPTLKSQIKAFLLRTLSSPSLDARSTASQVIAKVAGIELPHKQWPELIGSLLSNAHQLPAPTRQATLETLGYICEEVSPDVVDQDHVNKILTAVVQGMNSTEENNDVRLAAIKALYNALGFAQANFSNDMERDYIMRIVCETTQSPELKIRRAAFECLVAISSTYYEKLAPYIQDIFNITAKAVREDEEPVALQAIEFWSSICDEEIDILEEYGGDFSGDSEVPCFYFIKQALSFLVPMLLETLLKQEEDQDQDEGAWNIAMAGGTCLGLVARTVGDDIVPLVMPFIEENITKPDWRQREAATYAFGSILEGPSPDKLVPLVNMALNFMLTALMKDPNNHVKDTTAWTLGRMFEFLHGSALDTPIITPANCQQIITVLLQSMKDVPNVAEKACGALYFLAQGYEDAASASSPLTPFFQDIVHALLTVTHREDAGESRLRTAAYEALNEVVRCSNDETAPMVVQLVPLIMMELHQTLENQKVSSDERQNELQGLLCGCLQVIIQKLGSSEPTKYHFMQYADQIMGLFLRVFASRSATAHEEAMLAIGALAYATGADFAKYMTEFYKYLEMGLQNFEDYQVCAITVGVVGDVCRALEEKVLPYCDGIMTQLLKDLSSNQLHRSVKPPIFSCFGDIALAIGENFEKYLLYAMPMLQSAAELSAHTSGADDDMTEYTNSLRNGILEAYSGIFQGFKGSPKTQLLMSYAPHVLQFLDSLYMEKDMDDVVTKTAIGVLGDLADTLGSSAGPLIQQSVSSKDFLKECLSSDDHLIKESAEWAKLAISRAISF

SEQ ID NO: 95 - DNA, 2616 bp, Glycine max
atggcaatggaagttacccaggtgcttttgagtgctcaatcaattgacggaaatgtacggaagcatgctgaggacagtctacgacaatttcaggagcaaaaccttcctggattcttggtctctctatctggagagttagcaagtgaagataaaccggttgatagccgaaagttggcgggtttgatactgaaaaatgctttggatgccaaggatgaaagcagaaagcaggaattggtccaaagatggttgtcgctggaccctgtggcaaagacccaagttaagtcatgcttgctacaaacactctcttctcttgtacctgatgctcggtctacagcaacccaagttattgctaaagtcgctggaattgagcttcctcagaaacagtggcctgagctgataggatcacttttatcaaatattcatcaagtaccttctcatgtcaaacaagcgactttggagaccctggggtatttgtgtgaggaggtatctcctcaggttgttgatcaggaccaagtaaataaaatacttactgccgttgttcaaggtatgaacgcgtctgaagggaacaatgatgttaggcttgctgctacaagggcattatataacgctcttgggtttgctcaggctaattttggcaatgatatggagcgtgattatatcatgagagttgtttgtgagacaactgtgtgccctgaagtgaaaatacgtcaagcagcctttgaatgtttggtctcaattgcagccatgtattatgaaaaattggctccttacatccaggatatatataacatcacagaaaaggctgttaggggtgatgaggagcctgttgctcttcaagccattgaattttggagtacaatttgtgatgaggagactgatatcttggaagaatatatgggtgattccaatggagactccgatataccttgtttttattttattaagcaagctcttcctgcacttatccctctgctgttggaaacattactcaaacaagaagaggatcaggatctggacgaaggtgcatggaatattgcaatggcaggtggtacatgccttggtttagttgctcgtactgttggagatgatattgtgccactggtaatgcccttcattgaggagaatattacaaaaccagattggaggcaaagggaggcagcctcatatgcttttggatctatcttggaggggccttcacctgacaaattagctcctcttgttaaccatgccttaccatttatgcttagtgccttagtgaaggacccaaacaaccatgtgaaagacaccactgcttggactttgggacgaatgttcgaatttcttcacagttcagttgttggtacatcaattattaatgagggaaattgccaacagattattactgttctccttcaaagcatgaaggatgttcccaatgttgctgagaaggcctgtggtgctctgtattttcttgcccagggttatgaggatgttggaccaacatctcctctaactcccttttttcaggaaattgttcaatcccttctaactgttacccacagagaggatgctacagaatcacgattgagaactgcagcatatgaaacattgaatgaagtagtaaggtgttcaacagatgaaacagcttctttggtggtacaactagtttctgtcatcatgatggagctgcacaaatgtcttgaagtacaaaatctttcatctgatgagagagaaaagcagagtgaattgataggccttctttgtggatgcatgcaagtaattattcagaagctagggtctttagattctaccaaatatctgttgttgcagtattctgatcagataatgggacaattcttcagggtctttgcttgtagaaatgccactgcacatgaagaggcgatgctagccatcggagcccttgcctactcgattggccatgagtttgccaagtacatgccagaattttacaagtttctcgagatggaccttcagaactttgaggagtaccaagtttgtgctgtcactgttggtgtggtaggggacatatgcagggcattggaggaaaaaatactgccttattgtgatgggattatgacacaacttctcaagaatttgtcaagtgataatttgcaccgttctgtgaagcccccattattctcatgcattggtgatatagcacttgcaataggagataactttaataaatacttaatgtatgcaatgaacacactacaacttgctgcagagatgtatgcccacacatcaggttttgatgatgaaatgacagagtacattaattccttgagaaatgggatattagaggcatattctgcgatttttcaagggtttaagaattcatcaaagacccagctcttgattccttatgcacctcatatcctccagtttttggatagcatatacgtggaaaaagacatggacgaggtagttatgaaaacagcaattggagtccttggagatctagctgatacacttggaagcaatgctggttctttaatacagcagtctttgtcaagcagagactttttgaatgaatgtttgacctctgaagatcatttgattaaggaatctgctgagtgggccaggttggctatcaatcgtgctatatctgtttga

SEQ ID NO: 96 - protein, 871 aa, Glycine max
MAMEVTQVLLSAQSIDGNVRKHAEDSLRQFQEQNLPGFLVSLSGELASEDKPVDSRKLAGLILKNALDAKDESRKQELVQRWLSLDPVAKTQVKSCLLQTLSSLVPDARSTATQVIAKVAGIELPQKQWPELIGSLLSNIHQVPSHVKQATLETLGYLCEEVSPQVVDQDQVNKILTAVVQGMNASEGNNDVRLAATRALYNALGFAQANFGNDMERDYIMRVVCETTVCPEVKIRQAAFECLVSIAAMYYEKLAPYIQDIYNITEKAVRGDEEPVALQAIEFWSTICDEETDILEEYMGDSNGDSDIPCFYFIKQALPALIPLLLETLLKQEEDQDLDEGAWNIAMAGGTCLGLVARTVGDDIVPLVMPFIEENITKPDWRQREAASYAFGSILEGPSPDKLAPLVNHALPFMLSALVKDPNNHVKDTTAWTLGRMFEFLHSSVVGTSIINEGNCQQIITVLLQSMKDVPNVAEKACGALYFLAQGYEDVGPTSPLTPFFQEIVQSLLTVTHREDATESRLRTAAYETLNEVVRCSTDETASLVVQLVSVIMMELHKCLEVQNLSSDEREKQSELIGLLCGCMQVIIQKLGSLDSTKYLLLQYSDQIMGQFFRVFACRNATAHEEAMLAIGALAYSIGHEFAKYMPEFYKFLEMDLQNFEEYQVCAVTVGVVGDICRALEEKILPYCDGIMTQLLKNLSSDNLHRSVKPPLFSCIGDIALAIGDNFNKYLMYAMNTLQLAAEMYAHTSGFDDEMTEYINSLRNGILEAYSAIFQGFKNSSKTQLLIPYAPHILQFLDSIYVEKDMDEVVMKTAIGVLGDLADTLGSNAGSLIQQSLSSRDFLNECLTSEDHLIKESAEWARLAINRAISV

SEQ ID NO: 97 - DNA, 2613 bp, Glycine max
atggccatggaggttactcaaatccttttaaatgcccaagcagtggatggaacattaaggaaacaagccgaggaaagcctgaaacaatttcaggaacagaatcttccaagtttcttattttctcttgctggggaactggcaaatgacgagaagcctgcagagagtcggaagctagcaggtttaattctcaagaatgctctggatgctaaagagcagcacagaaaaatagaatttgtccaaagatggctgtcattggacccaaccttgaaagctcagattaaggcattcttgttgaggacactttcttccccttctcttgatgcccgatcaactgcatcacaggttattgctaaagttgctggcattgagttgcctcataaacagtggcctgaattgataggatccctgttgtctaatgctcatcagcttcctgcccctacaagacaggcaacacttgagacccttggatacatctgcgaagaagtttccccagatgtagtagaccaggatcatgtaaataagatactcactgctgttgttcaagggatgaattcaacagaagaaaacaacgatgtcaggcttgctgccataaaagcattgtacaatgcattgggttttgcccaggcaaatttttcgaatgacatggagcgggattatatcatgagaattgtgtgtgagacaacacaatctcctgaactgaagattcgacgagcagcatttgagtgcttggtagctatttcttcgacatactatgaaaagttagctccttatatccaagatatcttcaacatcactgccaaggctgtgagggaagatgaggagccagttgcacttcaggcaattgagttttggagttcaatatgtgacgaagaaattgatatactagaagaatatggaggtgatttcagtggggattcagaggttccctgcttttattttattaaacaggcactttcatttcttgtccccatgttattggagacactgctgaagcaagaagaagatcaagaccaggatgaaggagcatggaacattgctatggctggaggtacctgcttgggattagttgcacggacagttggtgatgacattgtacctttggttatgccgtttattgaagagaatataaccaaaccagattggaggcaaagggaagctgcaacttatgcctttggctctattttagaaggtccatctcctgataaacttgtgccattggtgaatatggctttgaatttcatgctcactgcattgatgaaagatccgaataatcatgtgaaggacacaactgcatggactcttgggcgaatgttcgaatttttgcatggatcagctctggatactcccattatcactccagcaaactgccaacagattattactgtgctgcttcagagcatgaaagatgttccaaatgttgctgagaaggcttgtggtgctctttattttcttgcccaaggctatgaggatgctggatctgcatcctctccgttgacccccttcttccaagaaattgttcatgctctcctcactgtaactcacagagaggatgctggagaatcccgccttagaacagcagcctatgaagcgttaaatgaagtagtgaggtgttctaatgatgaaacagctcctatggtggtacaacttgttcctctcatcatgatggaactccatcagactcttgagaatcagaaggtttcatccgacgagaggcagaatgagttacaaggccttctatgtggttgcttgcaggttatcatacagaagttaggatcatctgaaccaacaaaatatcatttcatgcagtatgctgaccaaattatgggtttgtttttgagagtgtttgcttctcgaagtgcaacagctcatgaggaggctatgcttgccattggggctttggcctatgcaaccggtgctgattttgcgaaatacatgacagaattttacaagtatttggagatgggtctccaaaatttcgaggactaccaggtttgtgctatcacagtgggtgtggttggtgatgtatgcagagccttggaggagaaaatactgccttattgtgatgggataatgacccaacttcttaaggatttgtctagcaatcagttgcataggtccgttaagcctcctattttttcatgttttggagacattgccttggcaattggagaaaactttgagaaatacctgttatatgcaatgcctatgcttcagagtgccgcagagctctctgctcatacatctggtgctgatgacgatatgacagaatacactaattctttgagaaatggaattctagaggcatactcagggatcttccaagggtttaaaggttccccaaagacccagcttctgatgccatatgctcctcatgtgctgcaattcttggatagtttgtataatgagaaggacatggatgatgttgtgactaagacagcaattggcgtgcttggagatttagctgatactttgggtagtaacgctggcccgttgattcagcaatctgtgtccagcaaagacttccttaaagagtgtttatcatctgatgatcatttgattaaggaatctgcggaatgggccaagttggcaatcagtcgagcaatttctttttga

SEQ ID NO: 98 - protein, 870 aa, Glycine max
MAMEVTQILLNAQAVDGTLRKQAEESLKQFQEQNLPSFLFSLAGELANDEKPAESRKLAGLILKNALDAKEQHRKIEFVQRWLSLDPTLKAQIKAFLLRTLSSPSLDARSTASQVIAKVAGIELPHKQWPELIGSLLSNAHQLPAPTRQATLETLGYICEEVSPDVVDQDHVNKILTAVVQGMNSTEENNDVRLAAIKALYNALGFAQANFSNDMERDYIMRIVCETTQSPELKIRRAAFECLVAISSTYYEKLAPYIQDIFNITAKAVREDEEPVALQAIEFWSSICDEEIDILEEYGGDFSGDSEVPCFYFIKQALSFLVPMLLETLLKQEEDQDQDEGAWNIAMAGGTCLGLVARTVGDDIVPLVMPFIEENITKPDWRQREAATYAFGSILEGPSPDKLVPLVNMALNFMLTALMKDPNNHVKDTTAWTLGRMFEFLHGSALDTPIITPANCQQIITVLLQSMKDVPNVAEKACGALYFLAQGYEDAGSASSPLTPFFQEIVHALLTVTHREDAGESRLRTAAYEALNEVVRCSNDETAPMVVQLVPLIMMELHQTLENQKVSSDERQNELQGLLCGCLQVIIQKLGSSEPTKYHFMQYADQIMGLFLRVFASRSATAHEEAMLAIGALAYATGADFAKYMTEFYKYLEMGLQNFEDYQVCAITVGVVGDVCRALEEKILPYCDGIMTQLLKDLSSNQLHRSVKPPIFSCFGDIALAIGENFEKYLLYAMPMLQSAAELSAHTSGADDDMTEYTNSLRNGILEAYSGIFQGFKGSPKTQLLMPYAPHVLQFLDSLYNEKDMDDVVTKTAIGVLGDLADTLGSNAGPLIQQSVSSKDFLKECLSSDDHLIKESAEWAKLAISRAISF

SEQ ID NO: 99 - DNA, 915 bp, Hordeum vulgare
atgagagggagaagcggaccgatctgcagggccttctcttgtggttgcctacaggtcattatccagaaagtgggagggatggagtcaacaaagtttgccttcttacagtatgcagatcagatgatggatctgtttttgagagtttttgcttgccgaaatgccacggtgcatgaggaggctatgcttgctatcggtgcactggcatatgcagccggttcgaactttgcgaagtacatggcacaattctatcagtatttggaaatgggacttcagaactttgaagagtatcaggtatgtgccattacggtgggtgttgtgggcgacttgtgcagggcactggaggacaaaattttgccctactgtgatggcatcatgacccagctcctgaaggatctatccagcaatcagttgcacagatctgtaaaaccacctatattctcatgcttcggtgatattgcactggcaattggagagaacttcgagaagtatttgatctatgccatgcccatgctacaaagtgcagcagatttgtcggcgcacacaactgcaactgatgatgaaatgcttgactacaccaatcaattaagaaatggcatcttggaggcctactctggtattcttcaaggattcaagagttcccctaagacacagttactcatgccgtatgctccacatattcttcagttccttgatgcccttcataatggaaaggatatggatgattctgtgatgaagactgcaataggtgtcttaggagatcttgcagacacattgggcgtcaatgctggtcctttgatcaatcaatccacatcaagcaagcaatttttggatgagtgcttatcatctgatgatcctttggtcaaagaatcagctgactgggcaaggattgcaatcagccgtgcagtttcaggttga

SEQ ID NO: 100 - protein, 304 aa, Hordeum vulgare
MRGRSGPICRAFSCGCLQVIIQKVGGMESTKFAFLQYADQMMDLFLRVFACRNATVHEEAMLAIGALAYAAGSNFAKYMAQFYQYLEMGLQNFEEYQVCAITVGVVGDLCRALEDKILPYCDGIMTQLLKDLSSNQLHRSVKPPIFSCFGDIALAIGENFEKYLIYAMPMLQSAADLSAHTTATDDEMLDYTNQLRNGILEAYSGILQGFKSSPKTQLLMPYAPHILQFLDALHNGKDMDDSVMKTAIGVLGDLADTLGVNAGPLINQSTSSKQFLDECLSSDDPLVKESADWARIAISRAVSG

SEQ ID NO: 101 - DNA, 2607 bp, Hordeum vulgare
atggatatcactcagattctgctagctgctcagtctccagatggtaaccttcgctcagcagcagaagccaacatcaagcagttccaggagcagaatcttcccaacttcctcctatccttgtcggtggagttatcgaatgatgaaaggccaccagagtctagaagacttgctggtattatccttaagaattcactggacgcaaaagattctgcaaggaaggagctgctgattcagcaatgggtcagcttggatcactcgatcaaatcgcagattaaggagtcattgctgataacactaggatcttcggtgggtgatgcccggcagacgtcatcacaagtcattgcaaagattgcatccattgagataccccgtcgggaatggcaagacctcattgccaaattgctgagcaacatgactcagcctggggcctctgcgccactaaagcaagcaactctagaagcattggggtatgtctgtgaggagattcctcctgagcacttggagcaggatcaagtgaatgctgttctgactgctgtggttcaggggatgaaccagacagagctaagctctgaagtccgtcttgcagcagtcaaagctctatataatgctcttgactttgctgagagcaactttgcaaatgagatggagaggacctttataatgaaggtaatttgtgatactgctgtatctaaagaagtggagatcagacaggcagcctttgaatgccttgtggcaattgcatccacatattatgtgcacttagatccttatatgcaaaccatattcaacctgacagctaatgctgtaaaaggagacgaggaaccagttgcactgcaagctgttgagttctggagtactatttgtgaggaggagattgaactccaagaggaatatgagggatctgatgatgctaactcgactgtaaattatcgcttcattgaaaaggccctcccttcacttgttccaatgctgctagaaaccctgttgaagcaagaggaagatcaagagcaagatgataatgcttggaacatttccatgagtggtggaacatgccttggactcattgctagaactgtcggtgatgcaattgtccctcttgtgatgccatttgttgaagctaacatcacaaagccggattggcgttgtcgtgaggcagcaacttttgcatttggttctatccttgatggcccatcccttgagaaacttgctcccttggtgcaggctggactagatttcttgctcaatacaatgaatgatccaaacagccaggtaaaagacaccactgcttggactcttggacgggtatttgagcttttgcattctccatgcagtactaatccaatcatatcaaatgcaaaccttcctcgtatcatggctgtgttgctagagagtagcaaagatgttccaaatgtggctgagaaagtctgtggagccatatattttcttgcccaaggttatgaagatgcagagccggtgtcatctttgcttacaccttatcttcctaatgttatcgctgcactccttactgctgcggatcgtagtgatatgacccatgtgaggcttcgtgcatctgcttatgaagcgctgaatgagattgtaagagtcagcaacatacctgaaacttcaagcatcataggccagttattgcaggagatcatgagaagattgaatctgacatttgaccaccaaatattttcatcaggcgacaaggagaagcaaagcgatctgcaggctttgttgtgtggtgtactgcaggtcattatccagaaactgaacagctcggatgcaaagtccataattgcacagactgctgaccagttgatgcttctgttcctccgtgtctttgcttgccacagtgctactgtacatgaagaagcaatgctggccattggtgctcttgcttatgccactggcccagattttgagaaatacatgcctgagtttttgaagtaccttgaggcaggattgcagaattatgaagaataccaagtatgctccatctctgtaggggtggtgggtgatatttgccgtgccttggaagataaaatcttgcccttctgtgatgggattatgactgtgcttctcaaggatctctcaaactcacagctcaacaggtctgtcaagcccccaattttctcatgctttggagacattgctcttgccattggtgaaaattttgagaaatacctgccgtatgctatgccgatgcttcaaggggcggctgagcttcttgttgttttggatcaaaatgacgaggatatggttgattatggtaaccagctcagacggggaatttttgaggcatactctggcatactacagggtctaaagggcgcaaaagctcagctgatgataccttatgcaggccatctattgcaattcactgaagctgtctacaaagatgggagcagggatgagagcgtgacaaaagccgccgttgctgtcctgggggatcttgcggacacacttgggccaatctctaaggatctgttcaagagccacctcttccatgttgagttcttgagggagtgcctcgatctggatgatgaagtgagggagacggcgtcatggacccaggggatgataaaccaagcgatagtttcttag

SEQ ID NO: 102 - protein, 868 aa, Hordeum vulgare
MDITQILLAAQSPDGNLRSAAEANIKQFQEQNLPNFLLSLSVELSNDERPPESRRLAGIILKNSLDAKDSARKELLIQQWVSLDHSIKSQIKESLLITLGSSVGDARQTSSQVIAKIASIEIPRREWQDLIAKLLSNMTQPGASAPLKQATLEALGYVCEEIPPEHLEQDQVNAVLTAVVQGMNQTELSSEVRLAAVKALYNALDFAESNFANEMERTFIMKVICDTAVSKEVEIRQAAFECLVAIASTYYVHLDPYMQTIFNLTANAVKGDEEPVALQAVEFWSTICEEEIELQEEYEGSDDANSTVNYRFIEKALPSLVPMLLETLLKQEEDQEQDDNAWNISMSGGTCLGLIARTVGDAIVPLVMPFVEANITKPDWRCREAATFAFGSILDGPSLEKLAPLVQAGLDFLLNTMNDPNSQVKDTTAWTLGRVFELLHSPCSTNPIISNANLPRIMAVLLESSKDVPNVAEKVCGAIYFLAQGYEDAEPVSSLLTPYLPNVIAALLTAADRSDMTHVRLRASAYEALNEIVRVSNIPETSSIIGQLLQEIMRRLNLTFDHQIFSSGDKEKQSDLQALLCGVLQVIIQKLNSSDAKSIIAQTADQLMLLFLRVFACHSATVHEEAMLAIGALAYATGPDFEKYMPEFLKYLEAGLQNYEEYQVCSISVGVVGDICRALEDKILPFCDGIMTVLLKDLSNSQLNRSVKPPIFSCFGDIALAIGENFEKYLPYAMPMLQGAAELLVVLDQNDEDMVDYGNQLRRGIFEAYSGILQGLKGAKAQLMIPYAGHLLQFTEAVYKDGSRDESVTKAAVAVLGDLADTLGPISKDLFKSHLFHVEFLRECLDLDDEVRETASWTQGMINQAIVS

SEQ ID NO: 103 - DNA, 2619 bp, Oryza sativa
atgtcactggatattactcaagttctcttgagtgcacaatctcctgatggcgcgactaggaagcttgctgaagaaagccttaagcagttccaggagcaaaacctcccaggtttcttgttctccctctcaaatgagttggccaatgaggagaaacctgaggaaagccggaggttggctggcttgattctcaagaatgcactggatgccaaggagcagcacaggaagaatgagcttttccagagatggctggcactagatgttggcgttaaggcacagattaaaggatttcttttgcaaactctctcatctcctgttgcaagtgccagatctacctcttctcaagttatcgcaaaggttgctggaattgagattccacagaagcaatggcctgaacttattgcgtcgttgctctcaaacatacatcaggtccagccaaatgtcaagcaagcgacgcttgagacacttggctacttatgtgaagaagtttctccagaagctgttgaccaagaccaagtcaataaaattcttactgctgttgttcagggtatgaatgcttctgaagggaattctgatgtgaggcttgcagcaacacgggcattgtataatgcattgggctttgctcaggttaacttctccaacgacatggaacgtgattatatcatgagagttgtttgtgaagcaactcagtccactgatgtgaagataaggcaggctgccttcgagtgcttggtggctatctcatccacttattatgacaagctggctacgtacatgcaggacatatttaatattactgctaaggctgttaggggagatgaggagtcagttgcactccaggccattgaattttggagctccatatgtgatgaggaaattgacattttggatgagtacagtagtgagtttacagctgactctgatgttccttgctactattttatcaagcaagcacttcctgccttagtgccaatgctgctagagaccctcctcaagcaggaggaagaccaagacttggatgaaggtgcttggaatcttgcaatggctgggggtacttgtttgggccttgtggcgagaactgttggggatgatattgtacctcttgtgatgccttttgttgaggagaacataacaaagcctgattggaggcacagggaggctgcaacatatgctttcggttccattttggagggcccatcagctgataaacttgctcctcttgttaatgtcgcattgaattttatgttgtctgcactggtgaatgacccaagtaaccatgtgaaggacacaactgcttggacccttggaagaatatttgagtttcttcatggttctgcacttgaaactgctcctattatcacatctgagaactgtcagcaaatacttaccgtgcttcttcaaagcatgaaggatgtcccaaatgtggcagagaaggcatgcggagcactctatttccttgctcaaggctatgtggatgcaggatccgcttcgccgctaactcccttcttccaagatattattcagagccttctctttgttactcatagggaagatgctggagaatccagattgcgtactgcagcttatgaaactctaaatgaagttgtcagatgctccattgaagaaacaggccctattgttatgcagttggtacctgtgatcatgatggagctccatcagacacttgaggcaggaaagttatcaactgatgagagggagaagcggagcgaactgcagggccttctctgtggttgtttgcaggtcataatccagaagttgggagcgatggagtcaacaaaatattccttcttgcaatatgccgatcaaatgatggaactgtttttgagagtttttgcctgtcgaaacgccactgtgcatgaggaggctatgcttgctattggtgcattggcatatgcggcaggtccaaacttttcgaagtacatgcctcagttttatcagtatttggagatgggactacagaactttgaggagtatcaggtctgtgccattaccgtgggtgttgtgggtgatttgtgcagggcactggaggacaaaattctgccttactgtgatggaatcatgacccaactcctgaaggacttgtcgagcaatcagttgcatagatctgtaaagccacctatattctcatgctttggcgatattgcactggcaattggggagaactttgagaagtatttgatatatgccatgcccatgctacaaagtgcagcagatttgtcggcgcatgctgctgcagctgatgatgaaatgctcgattacaccaaccaattaaggaatggaatactggaagcatactctggtattcttcaaggatttaagagctcccctaagacacaattactgatgcagtatgctcccaatattcttaatttccttgatgctctttacaatgggaaggatatggatgatactgtgatgaagactgcgataggtgtactgggagatctcgcggacacgttgggtgtccatgctggccctttgatcaatcaatctatctcaagcaagaaatttttggaggagtgcttagcatctgatgatccactggtcaaagagtcagctgattgggcaagggttgcaatcagccgtgcggtttcaggttga

SEQ ID NO: 104 - protein, 872 aa, Oryza sativa
MSLDITQVLLSAQSPDGATRKLAEESLKQFQEQNLPGFLFSLSNELANEEKPEESRRLAGLILKNALDAKEQHRKNELFQRWLALDVGVKAQIKGFLLQTLSSPVASARSTSSQVIAKVAGIEIPQKQWPELIASLLSNIHQVQPNVKQATLETLGYLCEEVSPEAVDQDQVNKILTAVVQGMNASEGNSDVRLAATRALYNALGFAQVNFSNDMERDYIMRVVCEATQSTDVKIRQAAFECLVAISSTYYDKLATYMQDIFNITAKAVRGDEESVALQAIEFWSSICDEEIDILDEYSSEFTADSDVPCYYFIKQALPALVPMLLETLLKQEEDQDLDEGAWNLAMAGGTCLGLVARTVGDDIVPLVMPFVEENITKPDWRHREAATYAFGSILEGPSADKLAPLVNVALNFMLSALVNDPSNHVKDTTAWTLGRIFEFLHGSALETAPIITSENCQQILTVLLQSMKDVPNVAEKACGALYFLAQGYVDAGSASPLTPFFQDIIQSLLFVTHREDAGESRLRTAAYETLNEVVRCSIEETGPIVMQLVPVIMMELHQTLEAGKLSTDEREKRSELQGLLCGCLQVIIQKLGAMESTKYSFLQYADQMMELFLRVFACRNATVHEEAMLAIGALAYAAGPNFSKYMPQFYQYLEMGLQNFEEYQVCAITVGVVGDLCRALEDKILPYCDGIMTQLLKDLSSNQLHRSVKPPIFSCFGDIALAIGENFEKYLIYAMPMLQSAADLSAHAAAADDEMLDYTNQLRNGILEAYSGILQGFKSSPKTQLLMQYAPNILNFLDALYNGKDMDDTVMKTAIGVLGDLADTLGVHAGPLINQSISSKKFLEECLASDDPLVKESADWARVAISRAVSG

SEQ ID NO: 105 - DNA, 2625 bp, Physcomitrella patens
atggcgctggaggtgacgcaaatactgcttaacgcccagtctcctgatgggacggtcaggaagattgcagaggataatcttaagcaattccaggagcacaacctttctgcttttttggtatctctatctcatgaacttgccaataatgataaacctcccgaaagccgaaggcttgccggtttgatacttaaaaactccttggatgctaaggagagtgctcgaaagcaagaacttgtgacgagatgggtggcgttggatccaagcgtgaaggcgcaaatcaagactgctctttctcaaacccttgcctcagtggttgcggatgctcgtcatacttccgcgcaggttattgccaagattgctgctatcgagctgcctcagggcgaatggcccgagctggttgggtcattgttggcaaatatgggaggtcctcaaatggagcaacccgcgcatctgaagcaagcgacactagaagcccttgggtacgtatgtgaggaggtttcagccgacatcctggctcaggagcaggtgaactcaatactgactgccgttgtccagggcatgaactcgtccgagactagcaacgatgtccgacttgctgccacacacgctctgtataatgcccttgatttcgctcaaaccaacttcgaaaacgatatggagcgcgactatattatgagggtggtctgcgaagctactctctcaccagatgtcagagtccgccaggctgcctttgaatgcctggtctcgattggatccacctattatgacaagcttgcaccgtacatgcaagatattttcgcaatcacgtccaaagcagttagggaggatgaggagccagttgcccttcaagctactgaattttggagttccatctgtgatgaagagatcgagattcaggaagaatacagtgctgatttctctggagattcggaggtgccatacttccagttcatcaagcaggccttgcctgcccttgtcccactgttgttggaaactttgacaaagcaagaggaagatcaggacttggaagagggagcttggaacttgtccatggccggtgggacatgtttgggtttggtggctcgcaccgtcggggacgacgttgtgcctcttgttatgcctttcgtccaagagaacgtctcgaagcctgattggaggtgtcgggaagcagctacgtacgcctttggatccattcttgaggggccatctctagacaagctaaccccccttgtgaatgtggccctcaccttcatgctgaacgcaatgaaagattcgaacaaccatgttaaggatactactgcatggacgttaggaaggatcttcgagttccttcacggtccctcaattgaaactccagttatcaaccaaaccaacttgcacttgatacaggctgttcttctcgagagtattaaggacactcctaatgtggcggagaaagtctgtggagcaatctatttcttggcacaaggctatgaggaaagtggacagacatcctctccattatctcctttcttccagagcattgttcaagctctgctcgccactactgagcgggaggatagcggagattctcgactgcgaacatctgcatatgaaactctgaacgaagttgttagaatctcaacggaggatactgcttcgattgtcgtgcagctggtgcctgtgattatgcagaaactcaatcacactttagaaatggctgtcctctcgtctgacgaccgggagaagcagagcgaactgcaggctcttctgtgtggtgttctgcaggtcatcatccagaaattgggtgcatctgaaacgaccaagtatggcatcgtgcagtacgccgatcaaatgatgggtttgttccttcgtgttttcgcttgccgcagtgcaactgttcatgaagaagctatgcttgcgatcggagctcttgcatatgctacaggggctgagtttggaaaatacatgggcgagttttaccgttacttggaaatgggtctccaaaactttgaagaatatcaggtatgtgcagtaactgttggtgtagtcggtgacatttgtcgtgctctggaggagaaggttcttccttactgcgatggaatcatgacccagcttctgaaggacttgtccagcaatcagttgcatcgctcagtgaaaccacccattttctcgtgctttggggacattgccctggcaattggagagcactttgagaagtatctgatttacgcgatgccaatgcttcaaggagctgcggagctatctgctcaaccgtcaggtagtgacgatgaaatgattgaatacaataatcaactccgcagtggcattttcgaggcttactctggtattttccaaggatttaaatctaacaaggcggagctgatggcaccatacgctggacatattctgcaatttattcagaatgtgtatcatgacaaagacagggacgaagtggtaactaaggctgctattggagtcatgggtgatttggctgacactttgggggctagctctgccgctttgttccaacgtacagtattcttcaaagactttcttgatgaatgtacttcgtcggatgaccagcagctgaaagagacagcggagtgggcccagggcactatctcacgcatattatctggttga

SEQ ID NO: 106 - protein, 874 aa, Physcomitrella patens
MALEVTQILLNAQSPDGTVRKIAEDNLKQFQEHNLSAFLVSLSHELANNDKPPESRRLAGLILKNSLDAKESARKQELVTRWVALDPSVKAQIKTALSQTLASVVADARHTSAQVIAKIAAIELPQGEWPELVGSLLANMGGPQMEQPAHLKQATLEALGYVCEEVSADILAQEQVNSILTAVVQGMNSSETSNDVRLAATHALYNALDFAQTNFENDMERDYIMRVVCEATLSPDVRVRQAAFECLVSIGSTYYDKLAPYMQDIFAITSKAVREDEEPVALQATEFWSSICDEEIEIQEEYSADFSGDSEVPYFQFIKQALPALVPLLLETLTKQEEDQDLEEGAWNLSMAGGTCLGLVARTVGDDVVPLVMPFVQENVSKPDWRCREAATYAFGSILEGPSLDKLTPLVNVALTFMLNAMKDSNNHVKDTTAWTLGRIFEFLHGPSIETPVINQTNLHLIQAVLLESIKDTPNVAEKVCGAIYFLAQGYEESGQTSSPLSPFFQSIVQALLATTEREDSGDSRLRTSAYETLNEVVRISTEDTASIVVQLVPVIMQKLNHTLEMAVLSSDDREKQSELQALLCGVLQVIIQKLGASETTKYGIVQYADQMMGLFLRVFACRSATVHEEAMLAIGALAYATGAEFGKYMGEFYRYLEMGLQNFEEYQVCAVTVGVVGDICRALEEKVLPYCDGIMTQLLKDLSSNQLHRSVKPPIFSCFGDIALAIGEHFEKYLIYAMPMLQGAAELSAQPSGSDDEMIEYNNQLRSGIFEAYSGIFQGFKSNKAELMAPYAGHILQFIQNVYHDKDRDEVVTKAAIGVMGDLADTLGASSAALFQRTVFFKDFLDECTSSDDQQLKETAEWAQGTISRILSG

SEQ ID NO: 107 - DNA, 2628 bp, Physcomitrella patens
atggcgctggaggtaacacagatacttttaaacgctcagtctcctgatggaacggtcaggaagattgccgaggataaccttaagcagtatcaagagcagaatctctctgcctttttggtatctctatctcatgaacttgccaatgatgataagccgcctgagagtcgaaggctggctggtttgatcctcaaaaactcgctggatgctaaggaaagttctcggaagcacgaactcgtgacaagatgggtggccttagactctactgtgaaggctcaaatcaagcctgctctttctcaaactctctcctccatggtggcggatgctcgtcacacagctgcgcaagttatcgctaagattgctgctattgaactgcctcagggcgattggcctgagcttgtggggtcacttttggccaacatggggggccctcaagtagagcaaccctcacatctgaaacaggcaacactagaagctcttggctatgtctgcgaggaggtttctgcggagatccttgctcaagagcaggtgaattctatcctgactgctgtggtccagggaatgaactcatccgagacgagtaacgacgtccgacttgcagccactcacgctctgtacaatgctcttgacttcgcgcaaacgaatttcgagaacgacatggaacgtgactacatcatgaggatggtttgtgaggccacgctctcacctgatgttcgagttcgtcaggccgcatttgaatgtttagtatccattggatctacgtactatgacaagctcgcaccgtacatacaagacattttcgccatcacttctaaggcagtcaaggaagatgaggagccggttgcacttcaagccatcgagttttggagctctatttgtgacgaagaaattgagattcaggaagattacaatgttgatttttctggtgactcggaggtgccgtatttccagttcatcaaacaggcattgcctgctttagtccctatgttgttagaaactcttacaaaacaagaagaggaccaggatttggatgaaggggcgtggaacttgtccatggccggtgggacgtgtctgggtctggtcgctcgtgccgtcggggacgatattgtgcctctggtcatgccctttgtagaacaaaatgtctcaaatccattggattggagatgtcgtgaggcggccacatacgcttttggttccattcttgagggtccttctttggacaagctgactcctcttgtaaatcttgcgctcaacttcatgttgagtgcaatgaaagatgtaaataatcacgtcaaggatactacagcatggacgttgggaaggatctttgagttccttcatggaccttcgcttgagcctccagttatcaccccaaccaatctgcccttgatcattgctgtgcttctcgagagcatcaatgatacacctaacgtggctgagaaggtttgtggagcaatttatttcctggcacagggttatgaggacggtgggcagtcatccactcctctttctccttacttcccgaaaatcctggaagctttgttggctgcgacggcgagagaggacagcgtagactctcggcttcgaacttgtgcatatgagactctaaacgaagttgtgagaatatcaacggatgacactgccccaatcgttgtgcagttagtgcctgtgattatggagaaactcaatcaaactttggaaatggccgtgctttcttctgacgatcgggagaagcagattgaactgcaggctcttctctgtggtgttctccaggtcatcattcaaaagttgggtgcatctgagctcacaaagtacggcgtcgtacagtttgccgatcagatgatgggtctgttcctccgcgtctttgcttgccgaagtgccacagtccacgaggaagctatgcttgcaatcggagctttggcatatgcaacgggtgctgaattcggaaaatacatgagcgaattttaccggtacttggaaatgggtcttcaaaactttgaagaatatcaggtgtgtgctgttacagttggtgtggtcggggatatctgtcgcgccttggacgagaaggtgctcccctactgtgatggaattatgacccagcttctgaaggacttatcaagcaatcagttgcatcgctcagtgaagccacccattttctcatgcttcggggatatcgccctggctatcggggagcactttgagaaatatttgatttacgcaatgcccatgctccaaggagctgcagagctttctgcccaacctacagctggtgatgatgaaatgaccgattacagtaaccagctacgcagtggtattttggaggcatactccggtattttccaaggtttcaagtcaaacaaggcggacttgatggcaccttatgctgcgcatattctgcaatttattgagaacgtttatcaggacaaagacagggatgatgtggtgacgaaggctgcaattggagttatgggtgatttggctgatacgcttggagccaatgctgcggctttgtttcaatgtacagtattctataaagacttccttgatgaatgcatttcttcagatgaccagcagctgaaagagacagctgagtgggctcagggcacaatcacacgcattctatctggttga

SEQ ID NO: 108 - protein, 875 aa, Physcomitrella patens
MALEVTQILLNAQSPDGTVRKIAEDNLKQYQEQNLSAFLVSLSHELANDDKPPESRRLAGLILKNSLDAKESSRKHELVTRWVALDSTVKAQIKPALSQTLSSMVADARHTAAQVIAKIAAIELPQGDWPELVGSLLANMGGPQVEQPSHLKQATLEALGYVCEEVSAEILAQEQVNSILTAVVQGMNSSETSNDVRLAATHALYNALDFAQTNFENDMERDYIMRMVCEATLSPDVRVRQAAFECLVSIGSTYYDKLAPYIQDIFAITSKAVKEDEEPVALQAIEFWSSICDEEIEIQEDYNVDFSGDSEVPYFQFIKQALPALVPMLLETLTKQEEDQDLDEGAWNLSMAGGTCLGLVARAVGDDIVPLVMPFVEQNVSNPLDWRCREAATYAFGSILEGPSLDKLTPLVNLALNFMLSAMKDVNNHVKDTTAWTLGRIFEFLHGPSLEPPVITPTNLPLIIAVLLESINDTPNVAEKVCGAIYFLAQGYEDGGQSSTPLSPYFPKILEALLAATAREDSVDSRLRTCAYETLNEVVRISTDDTAPIVVQLVPVIMEKLNQTLEMAVLSSDDREKQIELQALLCGVLQVIIQKLGASELTKYGVVQFADQMMGLFLRVFACRSATVHEEAMLAIGALAYATGAEFGKYMSEFYRYLEMGLQNFEEYQVCAVTVGVVGDICRALDEKVLPYCDGIMTQLLKDLSSNQLHRSVKPPIFSCFGDIALAIGEHFEKYLIYAMPMLQGAAELSAQPTAGDDEMTDYSNQLRSGILEAYSGIFQGFKSNKADLMAPYAAHILQFIENVYQDKDRDDVVTKAAIGVMGDLADTLGANAAALFQCTVFYKDFLDECISSDDQQLKETAEWAQGTITRILSG

SEQ ID NO: 109 - DNA, 2613 bp, Populus trichocarpa
atggcattggagatcactcagtttctattggctgcccaatcaccggatgcaaatatccgtactcaggcagaggccagtcttaggcagttccaagagcagaacttgccccttttccttctatccttgtcagtggagcttgcaaacaatgtaaagcctttagaatcacgtagattggctggtattgttcttaaaaactctttagatgctaaagattctgtgagaaaggaacatcttgttcaacaatggatgacaattgaaatttctatcaaatcacaaatcaaagactcactcttgagaactcttgggtcatctgcatcggaagcaaggcacacttctgcccaagtaattgcaaaagttgcttccattgagattccacggaagcagtggcctgagctcatcggatcattgcttaataatatgacccagcaagatagtccggcagctttgaaacaggcgaccctggaaactcttggatatgtttgtgaggtgatatcgcatcaggatcttgtgcaggatgaagttaactctgttctcactgctgttgtccaaggcatgaaccttgctgaacacagtcatgaagtacgtattgcagcaacaaaggccttgtataatgccttagattttgcccagaccaactttgacaatgaaatggagcgcaattacatcatgaaggtggtatgtgaaacagcaatttccaaagaggcggatatcaggcaggctgctttcgagtgtcttgtttctatagcatcaacatactatgaggtgcttgaaccttatatgcagaccctcttccagctaacatcaaatgctgtaaaaggggatgaagagagtgttgccctccaagcaattgaattctggagctccatctgcgatgaagagatagagcttcaagaatatgggactgttgaaggtggggattctgggtctgctcattcacgcttcatagaaaaggccctcccatatcttgttcctttgttgttggatactatgttgaaacaggaggatcaggatcaggatgatagcatttggaatatatccatggcagggggaacctgtcttggtcttgttgctagaactgttggggattctattgtgaaacttgtaatgccctttgtcgagggtaatattcttaacccagattggcattgtcgcgaggcagccacatatgcatttggctccattctagaaggccctagcgttgaaacattgggtccacttgttactaatggcttggattttctgcttaatgcaataagggatgaaaataataatgtcaaggacacaactgcctggacgcttagtcgtatatttgagtttttgcactgtcctgccagtggattttctgtgatttccccggagaagctggaaagaattgtaactgtcttgctggagagtattaatgatgctccacatgtagctgaaaaggtttgtggggcaatctattaccttgcacagggatatgaagattctggaacaagttcctcgcttctaactcaacacatccctaggattatctctgaacttctcaaaactgctgagcggacagatgggagcgactttaagctcaggacttctgcttatgagacattgaacgaggttgttaggtcttccaatgttgtggaaacatcactaattattttggagctgctcaaaagcatcttgcataagttggggcagactctagagcttcaaattgtctcatcagatgatagagagaagcaaggggacttgcaagcttccctttgtgctgttatccaggtgatcatccaaaagcttagcagcactgatgagactaagcccagtacacttcaggcagcagatccaattatgattctgctcctcagggtttttgcttgccgcagctctactgtgcatgaggaagcaatgcttgcaatcggtgcactggctcatgcctctggtccagaattcgagaagtatatgcctgagttatacaaatacctggagatgggactacagaattttgaggagtacgaggtttgtgccatcacagttggggtgattggtgacatttgccgcgcactggaggacaaggttttaccatactgtgatgggatcatgaaccaccttgtctgcaatctccaaagtgctgaactcaaccggtcggtcaagcctcccatattctcctgctttggggacattgctcttgctataggcgagcaattctctaagtacattgagcctacagtagcaatgatgcggagtgctgctgaggtctgtgctcagatggataatagtgatgaggagttgatggattatggcaaccagcttaagcgtagcatatttgaagcttattctggtattcttcagggattcaaagattccaagcctgagttgatgctgccacatgctggtcaccttttccagttcatagaattggttttcagagagaaatatagggatgagagtgttacaaaagcagcagttgcggtgatgggtgatctggcagatgcccttggtccaaacacgaaaatactgtttaaagacaaagcattctgcgttcaattcctcggcgagtgtcttcaatctgaagatgaacatctcaaagagactgcaaattggacccaagtgatgattgctcgtgttgtttcatga

SEQ ID NO: 110 - protein, 870 aa, Populus trichocarpa
MALEITQFLLAAQSPDANIRTQAEASLRQFQEQNLPLFLLSLSVELANNVKPLESRRLAGIVLKNSLDAKDSVRKEHLVQQWMTIEISIKSQIKDSLLRTLGSSASEARHTSAQVIAKVASIEIPRKQWPELIGSLLNNMTQQDSPAALKQATLETLGYVCEVISHQDLVQDEVNSVLTAVVQGMNLAEHSHEVRIAATKALYNALDFAQTNFDNEMERNYIMKVVCETAISKEADIRQAAFECLVSIASTYYEVLEPYMQTLFQLTSNAVKGDEESVALQAIEFWSSICDEEIELQEYGTVEGGDSGSAHSRFIEKALPYLVPLLLDTMLKQEDQDQDDSIWNISMAGGTCLGLVARTVGDSIVKLVMPFVEGNILNPDWHCREAATYAFGSILEGPSVETLGPLVTNGLDFLLNAIRDENNNVKDTTAWTLSRIFEFLHCPASGFSVISPEKLERIVTVLLESINDAPHVAEKVCGAIYYLAQGYEDSGTSSSLLTQHIPRIISELLKTAERTDGSDFKLRTSAYETLNEVVRSSNVVETSLIILELLKSILHKLGQTLELQIVSSDDREKQGDLQASLCAVIQVIIQKLSSTDETKPSTLQAADPIMILLLRVFACRSSTVHEEAMLAIGALAHASGPEFEKYMPELYKYLEMGLQNFEEYEVCAITVGVIGDICRALEDKVLPYCDGIMNHLVCNLQSAELNRSVKPPIFSCFGDIALAIGEQFSKYIEPTVAMMRSAAEVCAQMDNSDEELMDYGNQLKRSIFEAYSGILQGFKDSKPELMLPHAGHLFQFIELVFREKYRDESVTKAAVAVMGDLADALGPNTKILFKDKAFCVQFLGECLQSEDEHLKETANWTQVMIARVVS

SEQ ID NO: 111 - DNA, 2616 bp, Populus trichocarpa
atggcaatggaagtgacccaggtgcttttgaatgcccaatctatagatgggaatgtgcggaagcatgcagaagaaagcttaaaacagtttcaggagcaaaacctgcccagttttttgctctctctctccggagagctagctaatgatgagaagcctgttgacagtcgtaaattagcaggtttaattcttaaaaatgcgttggatgcaaaggaacagcatagaaagcttgagcttgttcaaagatggttgtcgctggacaacaatgcaaagggtcaaattaaggcatgtttgttgaagacacttgcttctcctgtaccagatgcacggtcaactgcatctcaagttattgccaagattgcagggattgagttgcctcagagacagtggccagagctgattggatcacttttatccaatattcatcagttacctgctcatgtcaagcaagctactttagagactcttggatatttgtgtgaggaagtctcacctgatgttgtagatcaagaccatgtaaacaagatacttacagcagtagtacagggcatgaacgcaactgaaggaaacaatgatgttaggcttgctgcaacccgagcactgtacaatgcacttggatttgctcaggcaaacttcagcaatgatatggagcgtgattatatcatgagagtggtctgcgaggcaactttatccccagaaatgaagataagacaagctgcttatgagtgtctggtctctatttcatcaacatactatgagaaattggctccttatatgcaggatatctttaacatcacggcgaaggccgtgagggaagatgaagaacctgtagcccttcaagcaattgaattctggagttcaatatgtgatgaggagatagatatcttggaagaatatgggggtgatttcactggggattctgatgttccttgcttttactttattaagcaggctctccctgctttggtcccaatgttgttggagactctcctaaagcaagaggaggatcaggatcaagatgaaggagcttggaatattgcaatggctggtggaacatgccttggtttggttgcaaggactgtgggagatgatattgtgcagcttgttatgcaattcattgaagataacattacaaaaccagattggaggcatagagaggcagctacttatgcatttggctcgatcttggaaggtccttcccctgagaaactaacgcctcttgttaatgttgctttgaacttcatgctgactgctttgacaaaggatccaaataaccatgtgaaggatacaactgcttggacccttggtcgaatctttgaattcctccatggttcaactgtggatacaccgataattactcaagcaaattgccaacaaattgtcacggtactactccagagcatgaaggacgttgccaatgtagcagagaaggcatgtggtgccctctatttccttgcccagggttatgaagaggtgaccccatcatcacctcttactccttacttccaggaaattgtccagacacttctctttgttacccacagagaggatgctggggagtcccgattaaggactgctgcatatgaaacgttgaatgaggtggtgagatgctcgactgatgaaacagcaccaatggtgctgcaactggttcctgtcatcatgacggagcttcacaatactcttgaagggcagaagctttcttctgatgagagagagaagcagggtgaattgcaagggcttctctgtggttgcttacaggtcataattcagaagttaggctcctctgagccaactaagtatgtgttcatgcaatatgtagatcagattatggggctcttcctgagggtctttgcttgtagaagtgcaactgtgcatgaggaggccatgttagccataggagcccttgcctatgcaactggtcctgattttgcaaaatacatgccagagttttacaagtacctagaaatgggccttcagaattttgaggagtaccaagtctgtgctgtgactgtcggtgtggtgggtgatatctgcagggcattggaagataaaattttgccttactgtgatggtattatgactcagcttctcaaggatttatcaagcaaccagctgcatagatctgtgaagcctcctattttctctagctttggcgacattgccctggcaataggagagaattttgagaagtacttgatgtatgccatgccaatgctgcaaagtgccgcagagttgtctgcccacacatctgttgctgacgatgaaatgactgaatacacaaattctttgagaaatggaattttggaggcatactctggaattcttcaagggtttaagaattctcctaaaactcagctcttgattccttatgcacctcacatcctgcagttcttggatagcatgtacatggagaaagacatggatgatgtcgttatgaaaactgcaattggagtcctgggagatttagcagatacactgggaagtaatgctggctctttgatacagcaatctctttctagcaaagactttttaaatgaatgtttgtcttctgatgaccatatgattaaggaatctgctgaatgggccaagttggccatcagtcgtgccatttctgtttga

SEQ ID NO: 112 - protein, 871 aa, Populus trichocarpa
MAMEVTQVLLNAQSIDGNVRKHAEESLKQFQEQNLPSFLLSLSGELANDEKPVDSRKLAGLILKNALDAKEQHRKLELVQRWLSLDNNAKGQIKACLLKTLASPVPDARSTASQVIAKIAGIELPQRQWPELIGSLLSNIHQLPAHVKQATLETLGYLCEEVSPDVVDQDHVNKILTAVVQGMNATEGNNDVRLAATRALYNALGFAQANFSNDMERDYIMRVVCEATLSPEMKIRQAAYECLVSISSTYYEKLAPYMQDIFNITAKAVREDEEPVALQAIEFWSSICDEEIDILEEYGGDFTGDSDVPCFYFIKQALPALVPMLLETLLKQEEDQDQDEGAWNIAMAGGTCLGLVARTVGDDIVQLVMQFIEDNITKPDWRHREAATYAFGSILEGPSPEKLTPLVNVALNFMLTALTKDPNNHVKDTTAWTLGRIFEFLHGSTVDTPIITQANCQQIVTVLLQSMKDVANVAEKACGALYFLAQGYEEVTPSSPLTPYFQEIVQTLLFVTHREDAGESRLRTAAYETLNEVVRCSTDETAPMVLQLVPVIMTELHNTLEGQKLSSDEREKQGELQGLLCGCLQVIIQKLGSSEPTKYVFMQYVDQIMGLFLRVFACRSATVHEEAMLAIGALAYATGPDFAKYMPEFYKYLEMGLQNFEEYQVCAVTVGVVGDICRALEDKILPYCDGIMTQLLKDLSSNQLHRSVKPPIFSSFGDIALAIGENFEKYLMYAMPMLQSAAELSAHTSVADDEMTEYTNSLRNGILEAYSGILQGFKNSPKTQLLIPYAPHILQFLDSMYMEKDMDDVVMKTAIGVLGDLADTLGSNAGSLIQQSLSSKDFLNECLSSDDHMIKESAEWAKLAISRAISV

SEQ ID NO: 113 - DNA, 2616 bp, Populus trichocarpa
atggcgatggaagtgacccaggtgctattgaatgcccaatctatagacgggaatgtgcggaagcatgcggaagaaagcttaaaacagtttcaggagcaaaacctgcctggttttttgttctccctctctggagagctagcaaatgatgagaagcctgttgatagccgtaaattagcaggcttaatacttaaaaatgcattggatgcaaaggaacaacatagaaagctcgagcttgttcaaagatggttgtcgttggacaacaatgttaagggtcaaattaaggtgtttttgttgaagacccttgcttctcctgtaccggatgcacggtcaactgcatctcaagttattgctaagattgctgggattgagttgcctcagcgacaatggccggagctgataggatcacttttatctaatattcatcagttacctgctcatgtcaagcaagctactttagagactcttggatatttgtgtgaggaagtctcacctgatgttgtagatcaagaccatgtaaacaagatacttacagcagtagttcagggcatgaatgcatctgaaggaaacaatgatgttaggcttgctgcaacccgagcactgtacaatgcacttggatttgctcaagcaaatttcagcaatgatatggagcgtgattatatcatgagagtggtctgcgagtcaacactgtccccagaagtgaagatacgacaggctgcttttgagtgtttggtctctatttcatcaacatattatgagaaattggctccttatattcaggatatctttaacatcacagcaaaagctgtgagggaagatgatgaacctgtagctcttcaagcaattgaattctggagttcaatatgtgatgaggagatagatatcttggaagaatatgggggtgatttcactggggattctgagattccttgcttttactttattaagcaggctctccctgctctggtccctatgctgttggaaactcttcttaagcaagaggaggatcaggatcaagatgaaggagcttggaatattgcaatggctggcggaacatgccttggtttggttgcaaggactgtgggagatgatattgtgcaacttgttatgccattcattgaagagaacattacaaaaccagattggaggcaaagggaggcagcgacttatgcatttggctcaatcttggagggtccttcccctgacaagctaacacctcttgttaatgttgcattgaacttcatgcttactgcattgaccaaggatccaaataaccatgtgaaggatacaactgcttggacccttggtcgaatctttgaattccttcatggttcaactgtggatacaccaataattactcaggcaaattgccaacaaattgtcactgtgctacttcagagcatgaaggacgttgccaatgtagcagagaaggcatgtggtgccctctatttccttgcccagggttatgaagaggtgagcccatcatctccccttactccttacttccaagaaattgtccaggcacttctcactgttacccacagagaagatgctggcgagtcccgattaaggactgctgcatatgaaacgttgaatgaggtggtgaggtgctcaactgatgaaaccgcacctatggtgctgcaactggttcctgtcatcatgatggagcttcacaatactcttgaagggcagaagctttcttctgatgagagagagaagcagggtgaattgcaagggcttctctgtggttgcttacaggtcataattcagaagttaggctcctctgagccaactaagtatgtgttcatgcaatatgcagaccagataatgggactcttcctgagggtttttgcttgtagaagtgcaacagtgcacgaggaggccatgttggctattggagcccttgcctatgcaactggtccagattttgccaaatacatgccagagttttacaagtacttagaaatgggccttcagaattttgaggagtaccaagtctgtgcggttactgttggtgtggtgggggatatttgcagggcattggaagataaaactttgccttactgtgatggtattatgactcagcttctcaaggacttatcaagtaaccagttgcatagatctgtgaagcctcccattttctctagctttggcgacattgccctggcaataggagagaattttgagaagtacttgatgtatgccatgcccatgctgcagagcgctgctgagttgtctgcccacacagctgatgctgatgatgaaattactgagtacacaaattctttgagaaacggaattttggaggcatattctggaattcttcaaggttttaagaattctcctaaaactcagctcttgattccttatgcacctcacatcctgcagttcttggatagcatgtacatggagaaagacatggatgatgtggtgatgaaaactgctattggagtccttggagatttagcagatacactgggaagtaatgctggttctttgatacagcaatctctctctagcaaagactttttaaatgaatgtttgtcttctgatgatcatatgattaaggaatctgccgaatgggccaagttggccatcagtcgtgccatttcagtttga

SEQ ID NO: 114 - protein, 871 aa, Populus trichocarpa
MAMEVTQVLLNAQSIDGNVRKHAEESLKQFQEQNLPGFLFSLSGELANDEKPVDSRKLAGLILKNALDAKEQHRKLELVQRWLSLDNNVKGQIKVFLLKTLASPVPDARSTASQVIAKIAGIELPQRQWPELIGSLLSNIHQLPAHVKQATLETLGYLCEEVSPDVVDQDHVNKILTAVVQGMNASEGNNDVRLAATRALYNALGFAQANFSNDMERDYIMRVVCESTLSPEVKIRQAAFECLVSISSTYYEKLAPYIQDIFNITAKAVREDDEPVALQAIEFWSSICDEEIDILEEYGGDFTGDSEIPCFYFIKQALPALVPMLLETLLKQEEDQDQDEGAWNIAMAGGTCLGLVARTVGDDIVQLVMPFIEENITKPDWRQREAATYAFGSILEGPSPDKLTPLVNVALNFMLTALTKDPNNHVKDTTAWTLGRIFEFLHGSTVDTPIITQANCQQIVTVLLQSMKDVANVAEKACGALYFLAQGYEEVSPSSPLTPYFQEIVQALLTVTHREDAGESRLRTAAYETLNEVVRCSTDETAPMVLQLVPVIMMELHNTLEGQKLSSDEREKQGELQGLLCGCLQVIIQKLGSSEPTKYVFMQYADQIMGLFLRVFACRSATVHEEAMLAIGALAYATGPDFAKYMPEFYKYLEMGLQNFEEYQVCAVTVGVVGDICRALEDKTLPYCDGIMTQLLKDLSSNQLHRSVKPPIFSSFGDIALAIGENFEKYLMYAMPMLQSAAELSAHTADADDEITEYTNSLRNGILEAYSGILQGFKNSPKTQLLIPYAPHILQFLDSMYMEKDMDDVVMKTAIGVLGDLADTLGSNAGSLIQQSLSSKDFLNECLSSDDHMIKESAEWAKLAISRAISV

SEQ ID NO: 115 - DNA, 2616 bp, Populus trichocarpa
atggcaatggagatcactcagtttctattggctgcccaatcaccagatgcaaatatccgtactcaggcagaggctagtcttaggcagttccaagagcagagcttgccccttttcctcttatcattgtcagtggagcttgcaaacaatgagaagcctttggaatcacgtaggttggctggtattgttcttaaaaactctttagatgctaaagattctgtgagaaaggaacatcttgttcagcaatggatggcaattgaaatttccatgaaagcacaaatcaaagacttgctcctgaggactcttgggtcatctgcatcagaagcaagacacacttctgcccaagtaattgcaaaagttgcttccattgagattccacggaagcagtggcctgagcttatcggatcattgcttaagaatatgacccagcaagatagtcctgcagctttgaaacaggcaacattggaaactcttggatatgtttgtgaggagatatcccaccaggatcttgtgcaggatgaagtgaactctgttctcactgctgttgtccaaggcatgaaccttgctgaacatagttgtgaagtacgccttgctgctacaaaggccttatataatgccttagattttgctcagaccaactttgaaaatgatatggagcggaattacataatgaaggtggtatgcgagacagcaatttctaaagaggcagatatcaggcaggctgcttttgagtgtcttgtttctatagcgtcaacatactatgatgtgcttgaaccttatatgcagaccctcttccagctcacatcaaatgctgtgaaaggggatgaagagagtgttgccctccaagcaatagaattctggagctccatttgtgatgaagagatagagcttcaagaatatgggacccttgaaggtggagattcggggtctactcattcacgcttcatagaaaaggccctcccatatcttgttcctttgttgttggatactttgttgaaacaggaggaggatcaggatcaggatgatagcatttggaatatatccatgtcagggggcacctgtctaggtcttgttgctagaactgttggggattctgttgtgaaactagtaatgccctttgtagagggtaatattctgaagccagattggcattgtcgtgaggcagccacatatgcatttggctcaattctagaaggccctagccttgaaacattaggtccgcttgtttctaatggcttggattttctgcttaatgcgatgagggatgaaaataatcatgttaaggacacaactgcatgggctcttagtcgtatttttgagtttttgcactgtcctgccagtggattttctgtggtttccccagagaacctggaaaggattgtaactgtcttgctggagagtattaatgatgctccaaatgtagctgagaaggtttgtggggcaatctattaccttgcacagggatatgaagatgctggaacaaattcctcacttctaactcaatacatccctaggataatctctgaacttctcaaaactgctgagcggtcagatgggagcgattctaagatcaggacttctgcttatgaaacattgaacgaggttgttaggtcgtccaatattgtggaaacatctcaaattattttggaactgctcaaaagcgtcttgcataagttggggcagactatagatcttcaaattgtctcatcagacgatagagagaagcaaggggacttgcaagcatccctttgtgctgttatccaggtgattgtccaaaagcttagcagcactgatgagaccaagcccagtatacttcaggctgcagatacaattatgtttctgttcctcagggtttttgcttgccgcagatctactgtgcacgaggaagcaatgcttgcaattggtgcactggctcatgcctctggtccagaatttgagaagtacatgcctgagctatataagtacctggagatgggattacagaattttgaggaatatgaggtttgtgccatcacagttggggtgattggtgacatttgccgtgcattggaggacaaggtcttaccttactgtgatgggatcatgaaccaccttgtccgcaatctccaaagtgctgaactccaccggtcagttaagcctccaatatttgcctgctttggtgatgttgctcttgggataggtgagcaattctctaagtacgttgagcctacagtagcaatgatgcggagcgctgctgaggtctgtgctcagatggacaatagtgatgaggagttgatggattatggcaaccagcttaagcgtagcatatttgaagcttattctggtattcttcagggattcaaagattccaagcctgagttgatgctgccacatgctggtcatcttttccagttcatagaagtggttttcagagagaaatatagggatgagagtgtcacaaaagcagcagttgccgtgatgggtgatctggcggatgctcttggtcctaacacaaagatactgttcaaagacaacgcattctgcattcaatttcttggcgagtgtcttcaatccgacgacgaacatctcaaagagactgcaaactggacccaagtgatgatcgctcgcgttgtttcatga

SEQ ID NO: 116 - protein, 871 aa, Populus trichocarpa
MAMEITQFLLAAQSPDANIRTQAEASLRQFQEQSLPLFLLSLSVELANNEKPLESRRLAGIVLKNSLDAKDSVRKEHLVQQWMAIEISMKAQIKDLLLRTLGSSASEARHTSAQVIAKVASIEIPRKQWPELIGSLLKNMTQQDSPAALKQATLETLGYVCEEISHQDLVQDEVNSVLTAVVQGMNLAEHSCEVRLAATKALYNALDFAQTNFENDMERNYIMKVVCETAISKEADIRQAAFECLVSIASTYYDVLEPYMQTLFQLTSNAVKGDEESVALQAIEFWSSICDEEIELQEYGTLEGGDSGSTHSRFIEKALPYLVPLLLDTLLKQEEDQDQDDSIWNISMSGGTCLGLVARTVGDSVVKLVMPFVEGNILKPDWHCREAATYAFGSILEGPSLETLGPLVSNGLDFLLNAMRDENNHVKDTTAWALSRIFEFLHCPASGFSVVSPENLERIVTVLLESINDAPNVAEKVCGAIYYLAQGYEDAGTNSSLLTQYIPRIISELLKTAERSDGSDSKIRTSAYETLNEVVRSSNIVETSQIILELLKSVLHKLGQTIDLQIVSSDDREKQGDLQASLCAVIQVIVQKLSSTDETKPSILQAADTIMFLFLRVFACRRSTVHEEAMLAIGALAHASGPEFEKYMPELYKYLEMGLQNFEEYEVCAITVGVIGDICRALEDKVLPYCDGIMNHLVRNLQSAELHRSVKPPIFACFGDVALGIGEQFSKYVEPTVAMMRSAAEVCAQMDNSDEELMDYGNQLKRSIFEAYSGILQGFKDSKPELMLPHAGHLFQFIEVVFREKYRDESVTKAAVAVMGDLADALGPNTKILFKDNAFCIQFLGECLQSDDEHLKETANWTQVMIARVVS

SEQ ID NO: 117 - DNA, 2619 bp, Sorghum bicolor
atgtcacttgacgttactcaagttctcttaagtgcgcaatctgctgatggtgcaattaggaagcatgctgaagaaagtcttaagcagttccaggagcagaacctccctggattcttgctttccctctcaagcgagttggccaatgaagagaaacctgaggagagccgaaggttagctggcttgattcttaagaatgcactggatgcaaaggagcagcacaggaagaatgagcttttccagagatggctggcactggatgctggtgccaaggcacaaattaaaggattgttgctgcaaactctcacatctcctgttgcaagtgccagatccactgcttcccaagttattgccaaggttgctggtattgagattccgcagaagcaatggccagagcttataggatcattgcttataaacatacatcaggtccagccaaatgtcaagcaagcaacgcttgagactcttggctatttatgtgaggaagtttctccagatgctgtagaccaagaccaagtcaataaaatacttacagctgttgttcagggtatgaatgcttctgaggcaaactctgatgtgaggcttgcagctacacgggcattgtataatgctttgggctttgctcaggtgaacttctcgaatgacatggagcgtgactatatcatgagagtagtttgtgaagcgacgcagtctccggaggtgaagataaggcaggctgcctttgagtgtttggtggctatatcgtctacttactatgataagctggcaacatacatgcaggatatatttaatataactgcaaaagctgtgaggggagatgaggagtcagtagcactccaggctattgaattctggagttccatatgtgatgaggaaattgacattctggatgagtacagcagtgagtttacagctgattctgatgttccttgctactactttatcaagcaggctcttcctgccttagtgccgatgttgttggaaactctcctcaagcaagaggaagaccaagacttggatgaaggtgcttggaatcttgcaatggctgggggaacttgtttgggcctggtggcaaggactgttggtgatgacattgttcctcttgtaatgcctttcgtggaggagaacataaccaagtctgaatggagacagagagaggctgcaacatatgcctttggctctatcttggagggcccatcagctgataaactggctcctcttgttaatgttgcattgggcttcatgctgtctgcactgacgaaggatcccagtaaccatgtaaaggacacaactgcctggacacttgggagaatctttgagttccttcatggttcagcacttgaaactcctcctatcatcacggctgagaattgtcagcaaatacttactgtgctgcttcacagcatgaaggatgtcccaaatgtggctgaaaaggcatgtggagccctctatttccttgcacaaggctatgtggatgctggatctgcatcgccattatcccctttctttcaagatattgttcagaaccttcttatggtcactcacagggaggatgctggagaatctcggctgcgaacagcagcatatgagaccctaaatgaagttgtcaggtgctccactgaggcagcagcccctattgttatgcagttagtacctgtgatcatggtggagctccatcagacacttgaaactgaaaagctgtcaactgatgagcgggagaagaggagcgaactgcagggcctcctttgtggttgcttgcaggtcattatccaaaagttgggagggatggagtcaactaagtactctttcttgcagtatgctgatcagatgatggatctgtttttgagagtttttgcatgtcgaaatgccacagtgcacgaggaggctatgcttgctattggagcattggcatatgcagctggtccaaactttgcaaagtacatggcacagttttatcagtatttggagatgggacttcagaactttgaggagtatcaggtgtgtgccattaccgtgggcgttgttggtgatctctgcagagcactggaagacaaaattttacccttctgtgatggcatcatgactcagctcctgaaggacctgtccagtaaccagttgcacagatctgtgaagccaccgatattttcttgctttggtgatattgcactggcaattggggaaaactttgagaagtatttgatctatgcgatgcctatgctgcaaagtgctgctgatttgtcggcccataccacagcaactgatgatgagatgctcgactacaccaaccagctaaggaatggaatcttggaagcctactctggtatcctgcaaggattcaagagttcacctaagacacaactactgatgccatatgctccacatattattcagttccttgatgctctgtacaatggaaaggacatggatgatactgtgatgaagactgcaataggtgtcttgggagatctggctgacacattgggtgtccatgctggccctttgatcaatcaatccacctcaagccaggcatttttagaggaatgcttggcatcagatgatccattggtgaaagaatctgccgattgggcaaggatagcaatcagccgtgcagtttcgggttga

SEQ ID NO: 118 - protein, 872 aa, Sorghum bicolor
MSLDVTQVLLSAQSADGAIRKHAEESLKQFQEQNLPGFLLSLSSELANEEKPEESRRLAGLILKNALDAKEQHRKNELFQRWLALDAGAKAQIKGLLLQTLTSPVASARSTASQVIAKVAGIEIPQKQWPELIGSLLINIHQVQPNVKQATLETLGYLCEEVSPDAVDQDQVNKILTAVVQGMNASEANSDVRLAATRALYNALGFAQVNFSNDMERDYIMRVVCEATQSPEVKIRQAAFECLVAISSTYYDKLATYMQDIFNITAKAVRGDEESVALQAIEFWSSICDEEIDILDEYSSEFTADSDVPCYYFIKQALPALVPMLLETLLKQEEDQDLDEGAWNLAMAGGTCLGLVARTVGDDIVPLVMPFVEENITKSEWRQREAATYAFGSILEGPSADKLAPLVNVALGFMLSALTKDPSNHVKDTTAWTLGRIFEFLHGSALETPPIITAENCQQILTVLLHSMKDVPNVAEKACGALYFLAQGYVDAGSASPLSPFFQDIVQNLLMVTHREDAGESRLRTAAYETLNEVVRCSTEAAAPIVMQLVPVIMVELHQTLETEKLSTDEREKRSELQGLLCGCLQVIIQKLGGMESTKYSFLQYADQMMDLFLRVFACRNATVHEEAMLAIGALAYAAGPNFAKYMAQFYQYLEMGLQNFEEYQVCAITVGVVGDLCRALEDKILPFCDGIMTQLLKDLSSNQLHRSVKPPIFSCFGDIALAIGENFEKYLIYAMPMLQSAADLSAHTTATDDEMLDYTNQLRNGILEAYSGILQGFKSSPKTQLLMPYAPHIIQFLDALYNGKDMDDTVMKTAIGVLGDLADTLGVHAGPLINQSTSSQAFLEECLASDDPLVKESADWARIAISRAVSG

SEQ ID NO: 119 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 120 - DNA, 55 bp, Artificial sequence
  primer: prm22376
ggggacaagtttgtacaaaaaagcaggcttaaacaatgtctttgagaccaagcac

SEQ ID NO: 121 - DNA, 53 bp, Artificial sequence
  primer: prm22377
ggggaccactttgtacaagaaagctgggtgatccttcagctaaaagttgaatc

SEQ ID NO: 122 - DNA, 53 bp, Artificial sequence
  primer: prm22596
ggggacaagtttgtacaaaaaagcaggcttaaacaatggcaatggaagtgacc

SEQ ID NO: 123 - DNA, 53 bp, Artificial sequence
  primer: prm22597
ggggaccactttgtacaagaaagctgggtagcaataacctcaaacagaaatgg

SEQ ID NO: 124 - DNA, 1326 bp, Populus trichocarpa
atgtacggtggtgatgaagtgtcagctatagtcattgacttgggttctcacacttgcaaagctggttatgccggcgaggacgcacccaaggccgtctttccttctgttgtgggatcaattgatcaaatggatgttgatgacatgacaagcaacgagaagaatgctgctgtagattctaaaaataatgtcaaagattctgagaaagggaagggaaaacgtaaattatttgtaggatctcaggcctcagggtttcgtcgggaccatatggaggtgttatccccttttaaggatgggattgttgctgactgggatattgtggatagcatatgggatcatgctttcagggagtgtctattgattgatccaaaggagcatccaatgctacttgcagaaccttcgtccaacagtcaacaacagagagaaaggacagcagagcttatgtttgaaaagtacactactcctgcattatttttggcgaagaatgctgttttaacatcttttgcatcaggacgtgctacctcgctagttgttgatagtggtggaggatcaactacaattgcgccagtccatgatggttatgttattcaaaaggctgtggtcttttctcctattgggggagaacttcttactgattgcttgatgaaaagcttggagagcaaaggtgtcatgataaaaccaaggtactctttcaaaagaaaggaaatacagccgggcgtgtttcagagtgtggatcttgattttacaaatacaactgacagctacagactctactctcagagaatgattgcaagtgatatcaaggaatgtgtgtgtcgtgcaccggatacgccctatgatgaaagttcatactcaaacattccaatgactccatatgagcttccggatggccagacaattgaaattggagctgatggattcaagattccagatattctattcaatccatccttggtccagacaattcctggtatggataattttgtggagattgctcctagtgctcgcggtttgccacaaatggttattgaaagcattaataagtgtgatgttgatattcgaagagaactgttcagtagtatactgcttgctggtggaacagcatcaatgcaacagttgaaggaacggcttgagaaagatttgcttgaggagtctcctcaagctgccagagttaaagtgctggctagtggaaatgaaactgaaaggagattcagtgtctggataggagggagtatattggcatctcttggttcattccagcagatgtggttctccaaggccgagtatgaagagcatggggcgtcttatgtacagagaaaatgcccttga

SEQ ID NO: 125 - protein, 441 aa, Populus trichocarpa
MYGGDEVSAIVIDLGSHTCKAGYAGEDAPKAVFPSVVGSIDQMDVDDMTSNEKNAAVDSKNNVKDSEKGKGKRKLFVGSQASGFRRDHMEVLSPFKDGIVADWDIVDSIWDHAFRECLLIDPKEHPMLLAEPSSNSQQQRERTAELMFEKYTTPALFLAKNAVLTSFASGRATSLVVDSGGGSTTIAPVHDGYVIQKAVVFSPIGGELLTDCLMKSLESKGVMIKPRYSFKRKEIQPGVFQSVDLDFTNTTDSYRLYSQRMIASDIKECVCRAPDTPYDESSYSNIPMTPYELPDGQTIEIGADGFKIPDILFNPSLVQTIPGMDNFVEIAPSARGLPQMVIESINKCDVDIRRELFSSILLAGGTASMQQLKERLEKDLLEESPQAARVKVLASGNETERRFSVWIGGSILASLGSFQQMWFSKAEYEEHGASYVQRKCP

SEQ ID NO: 126 - DNA, 1284 bp, Populus trichocarpa
atgggcaagaaagaacagcaacttcaaccacagaaagatcacaaagacaatgatagaagtgaagctgttctcgagcttctaagaaaacatgctccactcactgttaaacaggagaagttctgcaacaatgcttgtgtggagaggtttctaagagcaaaaggtgataatgtgaagaaagctgctaagcacttaagggcctgcctttcttggagagagagtataggcactgagaatttgatagcggatgagttctcagctgagctagctgaaggagttgcttatgttgctggtcatgatgaagaatccagacctgttatgatttttcgaatcaagcaagattaccaaaagttccattcacaaaaactgttcactcggttgctagtgtttacactggaggtggcaatagggaccatgccaagaaacgcagaacaatttgttctcctctttgatgcaagctttttcaggtcagcatcggcttttatgaatttattgctcggaactctgaaaattgtggctgagtactacccaggcaggctttacaaggcttttgtaatcgacccgccttctctcttcccttatttatggaagggtgtccgtccatttgttgagctatcaacggccacgatggtggtatcttcactagactttgaagaatcactggagttcaatgacttttcctcctaccctcgagcctcctccctccgattggatccttcgtctgtcaagtcaacggctaagattggctcatgctcttcctctagattttccttcaccgtgtcccaccattttgactccctcaagccttggcacctaactttgactgacacgtcggcatcaaaagtaggaccaacaaacctctcttctctgggcccggccctcatctctcccctcaacgctagatccttttcttttgcgtcaccagttgccagaaccccacgtggcagcatgaacggtggcagctacactaggcttgcccagaaaagtctcttcccatcaaccccgttgccacagcgtgtcaccacgagtgacacactcaaaatctctcaaccgcggaccccacgcccctcgttcctccaatcacctgccttgtttttcaagaaggagtgccacgtcagcaaggcagacaggtctcgagaatcgttcgtgccatttttgaagttttataggaggccgtacgatgagatgatttataggtcaaagatgcggcctccactcgggggactcatatccattgtctcgcctcacatcaaacggcgccacatgtcagtatctcaacggttttaa

SEQ ID NO: 127 - protein, 427 aa, Populus trichocarpa
MGKKEQQLQPQKDHKDNDRSEAVLELLRKHAPLTVKQEKFCNNACVERFLRAKGDNVKKAAKHLRACLSWRESIGTENLIADEFSAELAEGVAYVAGHDEESRPVMIFRIKQDYQKFHSQKLFTRLLVFTLEVAIGTMPRNAEQFVLLFDASFFRSASAFMNLLLGTLKIVAEYYPGRLYKAFVIDPPSLFPYLWKGVRPFVELSTATMVVSSLDFEESLEFNDFSSYPRASSLRLDPSSVKSTAKIGSCSSSRFSFTVSHHFDSLKPWHLTLTDTSASKVGPTNLSSLGPALISPLNARSFSFASPVARTPRGSMNGGSYTRLAQKSLFPSTPLPQRVTTSDTLKISQPRTPRPSFLQSPALFFKKECHVSKADRSRESFVPFLKFYRRPYDEMIYRSKMRPPLGGLISIVSPHIKRRHMSVSQRF

SEQ ID NO: 128 - DNA, 1092 bp, Populus trichocarpa
atggaggcggcggtgatagacgctggtactcagctccttaaagccggcacagcagttccagatcaagctccgcccatgataattccgagccaaatgaaacgaatggtggaagatggagcatcgggtgataataatgaatccgtatttgaggatgtaactgtcgatcctgttgttcgaggttatataagagattgggatgcgatggaagatttgctgcattatgttttatacactagtcttggttgggaagagggaaatgaaggccaagttttgtttaccgatccgctttgcactcccaaggctgttagagaacaattggtacaattgatgtttgagacatttaatgtttctgggttttatgcatcggagcaagcggtgttgtctctttatgcagttgggcgtatctctggatgcaccgttgatatcggtcatgggaagattgatattgcaccagtacttgaaggtgctgttcagcacattgcttcaagaagatttgaaattggtggtgttgatttgacgaagttacttgcccaagaactgggtaaatctaatcttttggtgaatctcaatgcatctgatgctgagatgttaaaagtaaagtactcctgttgtgctgaagacgagcttgcttacgagaagactcaaaggtcaagtgatacagaggagcatacccttcctgatggacaggtgattagaattagaagagaaaaatatacaattggtgaggcattatttcaaccatctatactgggtatagaggcacttggaatagttgagcagcttgtacgtagtatttcaactgtttcttcagagaaccaccgccaactgctggaaaatactgtactttgtggtggcataacttctatgcctggttttgaagataggtttcagaaagaagcaagcctgtgctcatcagctattcgtccttcacttgtaaagcctccagaatatatgcccgataagttgacagagtactctgcatgggtgggaggtgccatactagccaaagttgtgttccctcagaatcagcatgttaccaagggagattacgatgaaactggaccatccattgtccatcggaaatgcttttga

SEQ ID NO: 129 - protein, 363 aa, Populus trichocarpa
MEAAVIDAGTQLLKAGTAVPDQAPPMIIPSQMKRMVEDGASGDNNESVFEDVTVDPVVRGYIRDWDAMEDLLHYVLYTSLGWEEGNEGQVLFTDPLCTPKAVREQLVQLMFETFNVSGFYASEQAVLSLYAVGRISGCTVDIGHGKIDIAPVLEGAVQHIASRRFEIGGVDLTKLLAQELGKSNLLVNLNASDAEMLKVKYSCCAEDELAYEKTQRSSDTEEHTLPDGQVIRIRREKYTIGEALFQPSILGIEALGIVEQLVRSISTVSSENHRQLLENTVLCGGITSMPGFEDRFQKEASLCSSAIRPSLVKPPEYMPDKLTEYSAWVGGAILAKVVFPQNQHVTKGDYDETGPSIVHRKCF

SEQ ID NO: 130 - DNA, 1179 bp, Hordeum vulgare
atgtcggtgtcgtcgcgtttcgagctccgggccccgtcaaaccttcaccagcagccaccgcctcccgtcggcatgagcggcgatgtggggacattcgccgacgcagggaacctcgagcactgtgccaagtacctcaatcagacgctcgttaccttcggtttcccggcctcgctcgacctattcgccaccgatccggtgtctattgcaagaacatgtaactgcatgtatgcactgctgcagcagcgccagagagacattgaattccgggaatcgaccaatgatctgcggcaacgtatgcagtctgatatttcaagactggaagccaagatcgaaagaatggatgcccaattggcagcaaaagatcgagagttggccactttgacccgaacggaggccaaaaacaccgcagctctgaaagctcatattgagaagctgcagcaggaacgcgacgaatttcaaaaaatggttattggaaatcagcaagtacgcacccaacaaattcatgaaacgaagaagaaagaaaaggaatacatcaaattgcaggagaagctaaaccaagtactgatggagaagaaaaaggaatcatcacgttcaggaatggaaataatgaacttgttgcagaaagagggacggcagcgtggaacatggactggaaaaaagaatgacaatgactactacaaaatgattgttgatgcatatgaagtgaagaagcaagaactagtccaggagaatgctgatttgcgggcactgttacgttcaatggagatggatatgcgcaagttccttaatgctccaactggatcatcacaggctgttgttgctggtaatggaagacaggaggcagggtctccccagcccccacttgggggcaagacggatgtctttgacttgccctttcacatggccagagaccagatagaggagagtttgcgcactaaaatggcttcagtaaaggcacgtatgacacaacttcaagatgctcaaaaagttgctgaagtgacctcggaagttaccgagcgtgaacttgagcttgaagctcagttagttgaagccagaagcatcatccaagagcaggcgtccatcatgtctaagcacttctccaagtctgataaaccaaggaggttaagtggcctggatgccgagcatgaggcgattcattctgcttctacagatgtgtaa

SEQ ID NO: 131 - protein, 392 aa, Hordeum vulgare
MSVSSRFELRAPSNLHQQPPPPVGMSGDVGTFADAGNLEHCAKYLNQTLVTFGFPASLDLFATDPVSIARTCNCMYALLQQRQRDIEFRESTNDLRQRMQSDISRLEAKIERMDAQLAAKDRELATLTRTEAKNTAALKAHIEKLQQERDEFQKMVIGNQQVRTQQIHETKKKEKEYIKLQEKLNQVLMEKKKESSRSGMEIMNLLQKEGRQRGTWTGKKNDNDYYKMIVDAYEVKKQELVQENADLRALLRSMEMDMRKFLNAPTGSSQAVVAGNGRQEAGSPQPPLGGKTDVFDLPFHMARDQIEESLRTKMASVKARMTQLQDAQKVAEVTSEVTERELELEAQLVEARSIIQEQASIMSKHFSKSDKPRRLSGLDAEHEAIHSASTDV

SEQ ID NO: 132 - DNA, 3282 bp, Populus trichocarpa
atgatatcagcatttggaggatctgatggtgggaaaaccatatgggagaatgctctacgctcttctatagaacggcttcatggtcaaaaacctaatctcacttctccagaaacccctttgcagtcacgtcctggtgtcagagctcctgatcaagcaattaaacagagtactgttcaaagtaaagtaatctcttcacctattggtcgatccagcaagggtactccaacaattgtgaaccccatggtacccctttcttcaccgctctggagtgtacctacccccgctggcgacacatttcaatcaagcagcatgccaaggggtcccattatggatcatcagcgggcactttctcctatgcatcctcatcaaactccacagataagaaattttgctggtaatccttggctatctcaggcacctttttgtggtccctgggctacatctccacaaacacctgcacttgacacaagtggtcatttttctgcgcaattgcctatcacagaaccagttcaattgacacctgtgaaagacttatccatgccaattatctctggtgcaaagcatgtttctcctggtcctgtagctcagagtggggcttccaccagtgtttttactgggacttttcctgttccagatgcaaaaaaggctgcagtgtcatccagtcaacctcctgctgatccaaaacctaggaaaagaaaaaagaactcggtttctgagagtccgggccagaatattttgcctcctcaccttcgaacagaatcagtttctgctcctgttgttaccagtcatctgtctacttctgttgccattacaacccctgtcatctttgtttctaaagcccctacagagaaatttgtgacttctgtatctcctacacctactgatatcagaaacgggaatcagaatgcagaacagaggaatattttgtcagaggaaacccttgataaagtgaaggctgtgagagtgcaggcagaggatgctgctactcttgctgctgctgctgttagtcacagcctggaaatgtggaatcagttagataagcagagaaattctggattatcaccagatattgaaaccaaactagcttctgcagctgtcgcaatagcagcagctgctgctgttgcaaaagcggcagcggcagctgccaaagttgcatctagtgctgcattgcaagcaaaactgttggctgatgaagcagtaaattctggtggttacagcaatcccagtcaagacaatacaatttctgtttctgaaggcatgaagaatttgggaaaggctactcctgcttccatcctgaagggtgatgatgggacaaacagttccagttcaatccttattgtggcaagggaggctgctagacggagagttgaagttgcttccgctgctgcaaaacgagctgaaaatatggatgctattgttaaagctgcggagctggctgcagaagctgtgtcccaagctgggaagatagttgctatgggcgatcctttgccactgaatgagctagtagctgtgggtccagagggatattggaaagtagccaaaataaataatgaactgatctctaaatcaaatgatataggtagaaaaactcttaatatagatagagttggagaaagaccacgcactccaactgaggggtccactgaggaccatgttagattggaagatggtttcttgagttctggtgcagctgctgcaaaggatgttaaaggacaaaagggctacaaggtgtctgaatctgagaatggttcaagatctttgggaactatagaaaactttaatagcatcaaggaggggtcccttgtagaggttttcaaagatgggaatggatttaaagcagcctggttctctgccaatgtcgtggatttaaaggatgggagtgcatgtgtgagttatactgatctttcatcagttgaaggctcagagaagctaaaggagtgggtgacacttaaaggtgaaggagagagagcgccaaaaatacgaatagctcgccctattactgccgtgcaattagaaggaacaaggaagaggcgacgagctgccacggtggaccatatttggtctgttggtgatagagtggatgcatggatacaagatagctggtgggaaggagtggtcattgaaaggagcaagaaagatggcaccacactaacagtccaatttccagttcaaggagaaaaatctgttgttagagcatggcatcttcggccctctctcctatgggaaaatggggaatggattgaatggtccagttcaagagtgggctctcattctaccaacaagggtgatactccacaggaaaaacgacctagggtgcggagccctgcagtggacaacaaagggaacgataagttgtcaaaaggttttgattctgtggaaactaataaacctgatgagccaactttattggatttagctgctcatgaaaaattgttcaatattggtaagagtaccaaagatggtaataaacctgacgtgctcagaatggcacggactggcttgcagaaggaaggatcaaaagtgatcttcggtgtaccaaagcctgggaaaaaaagaaagtttatggaagtgagcaagcactatgttgcagatcagagcagcaaaaacaacgacgcaaatgattcggtaaagtttgctaaatatttgatgcctcggggatcaggatcccgtggatggaagaatactttaagaactgaatcaatcgcaaaccgaacagcggcatcgaagcccaaggttttcaagtcaggaaagccacagaatgtttctggtagaacaattactcagaaggacaactcattgacaactacagtttctgcttccaatgatggtgctgttacagatcatgttgcaaagaccaaggcttctataagccatgttgaaaatacatccgaaaaacgtaacttgactgactttcagcccttatctagctccgtgggagcaacagagggtccaatattttcttcctttcctcttccttcaggtacactttcctctaagaaaacttccacatcaaatgctaaacctcaacgggtaagtaaaggaaaacttgctcctgctggtggaaagttgggtagaattgaagaggacaaagttttcaatggagattcttcaaaatcaaactctgatgtcacagagccacgaaggtctaaccgtaaaatgcagcctacatcaagactgttagaagggctacaaagctccttgatggtgtcaaaagttccagctgtgtcgcatgataaaagtcagaaaagtaggactgcttctagagggaataaccatggttga

SEQ ID NO: 133 - protein, 1093 aa, Populus trichocarpa
MISAFGGSDGGKTIWENALRSSIERLHGQKPNLTSPETPLQSRPGVRAPDQAIKQSTVQSKVISSPIGRSSKGTPTIVNPMVPLSSPLWSVPTPAGDTFQSSSMPRGPIMDHQRALSPMHPHQTPQIRNFAGNPWLSQAPFCGPWATSPQTPALDTSGHFSAQLPITEPVQLTPVKDLSMPIISGAKHVSPGPVAQSGASTSVFTGTFPVPDAKKAAVSSSQPPADPKPRKRKKNSVSESPGQNILPPHLRTESVSAPVVTSHLSTSVAITTPVIFVSKAPTEKFVTSVSPTPTDIRNGNQNAEQRNILSEETLDKVKAVRVQAEDAATLAAAAVSHSLEMWNQLDKQRNSGLSPDIETKLASAAVAIAAAAAVAKAAAAAAKVASSAALQAKLLADEAVNSGGYSNPSQDNTISVSEGMKNLGKATPASILKGDDGTNSSSSILIVAREAARRRVEVASAAAKRAENMDAIVKAAELAAEAVSQAGKIVAMGDPLPLNELVAVGPEGYWKVAKINNELISKSNDIGRKTLNIDRVGERPRTPTEGSTEDHVRLEDGFLSSGAAAAKDVKGQKGYKVSESENGSRSLGTIENFNSIKEGSLVEVFKDGNGFKAAWFSANVVDLKDGSACVSYTDLSSVEGSEKLKEWVTLKGEGERAPKIRIARPITAVQLEGTRKRRRAATVDHIWSVGDRVDAWIQDSWWEGVVIERSKKDGTTLTVQFPVQGEKSVVRAWHLRPSLLWENGEWIEWSSSRVGSHSTNKGDTPQEKRPRVRSPAVDNKGNDKLSKGFDSVETNKPDEPTLLDLAAHEKLFNIGKSTKDGNKPDVLRMARTGLQKEGSKVIFGVPKPGKKRKFMEVSKHYVADQSSKNNDANDSVKFAKYLMPRGSGSRGWKNTLRTESIANRTAASKPKVFKSGKPQNVSGRTITQKDNSLTTTVSASNDGAVTDHVAKTKASISHVENTSEKRNLTDFQPLSSSVGATEGPIFSSFPLPSGTLSSKKTSTSNAKPQRVSKGKLAPAGGKLGRIEEDKVFNGDSSKSNSDVTEPRRSNRKMQPTSRLLEGLQSSLMVSKVPAVSHDKSQKSRTASRGNNHG

SEQ ID NO: 134 - DNA, 1725 bp, Lycopersicon esculentum
atggaatcagctgctgtgacggttgagtcagttgctgacaaattgaagaagcagagtttgggaaatgatggaagtaacagtaaacgtatgttgaaacttgaagagctcaattgggatcattcatttgttcgtgaactgcctgctgatccaagaacagataccattccaagagaggtattgcatgcatgctatacgaaaatgttgccttctgttgaggtggagaatcctcagctcgttgtgtggtcagactcagtagctgagttacttgagttggatcctaaagaatttgagaggcctgattttccacttctgttctcaggggcatcacctttagttggagctgtgccttatgcccagaactatggaggacatcagtttgggatgtgggctggtcagctaggtgatggtcgagcaataactcttggagaggttttgaattcaaagtctgaaagatgggagctgcagctaaagggtgcagggaagaccccatatagccgttttgctgatggtcttgcagttcttcggagtagtatccgggagttcctctgcagcgaagcaatgcatagtcttggaatcccaactacaagagcactctgtcttgtgatgacaggaaaagatgtcagcagggacatgttttacgacgggaatccaaaggatgagcctggtgccattgtctgcagagttgctgaatcctttcttcgctttggctcttaccaactacatgcctctaggggtaaagaggaccttgagattgtgcgtactttagcagattacacaattagacatcatttcccccatctagagaacatgtgtaagagcgaaagcatatcattcagcataggcgaggaagatgatacggttgtggatttaacttcaaacaaatatgcagcatgggcagtggaagttgcagagcagactgcttccacaattgcgaggtggcaaggtgttggtttcacacacggagtgatgaataccgataacatgagtgtgttaggcctcaccattgattatggcccttttggatttttagacgcgtttgatcccagtttcacacccaataccactgatctacctggcagaagatactgctttgcgaatcagccggatataggtttatggaatgttgctcagtttgctacttctctatctactgcacagttgctaaatgataaggaggcaaattatgccatagagaggtatggcatcaaatttatggatgactatcaagctatcatgaccaaaaagcttggtttggtcaagtacaataaacaaatgattggtgaactacttaagaatatggctgtcgataaagttgattacacaaacttcttccgattactatcaaacatcaaagccgatcctacaattccagataaccagttactgattcctctcaaagctgcgctattggatattggtcaggagcgcaaggaagcttggacaagctgggtgaaatcctacatacaggagctctctactatcggtgtatcagacgatgagaggaaggcctcgatgaattctgttaatccaaagtacatccttagaaactatttatgccaaagtgcaatagatgcagctgaacaagacgattttggggaggtcagacgactactgaaagtcatgcaacgtccatttgacgaacaacctggcatggagaagtatgcgcgtctgcctccagcttgggcttatcgtcccggtgtaggcatgctttcatgttcctcataa

SEQ ID NO: 135 - protein, 574 aa, Lycopersicon esculentum
MESAAVTVESVADKLKKQSLGNDGSNSKRMLKLEELNWDHSFVRELPADPRTDTIPREVLHACYTKMLPSVEVENPQLVVWSDSVAELLELDPKEFERPDFPLLFSGASPLVGAVPYAQNYGGHQFGMWAGQLGDGRAITLGEVLNSKSERWELQLKGAGKTPYSRFADGLAVLRSSIREFLCSEAMHSLGIPTTRALCLVMTGKDVSRDMFYDGNPKDEPGAIVCRVAESFLRFGSYQLHASRGKEDLEIVRTLADYTIRHHFPHLENMCKSESISFSIGEEDDTVVDLTSNKYAAWAVEVAEQTASTIARWQGVGFTHGVMNTDNMSVLGLTIDYGPFGFLDAFDPSFTPNTTDLPGRRYCFANQPDIGLWNVAQFATSLSTAQLLNDKEANYAIERYGIKFMDDYQAIMTKKLGLVKYNKQMIGELLKNMAVDKVDYTNFFRLLSNIKADPTIPDNQLLIPLKAALLDIGQERKEAWTSWVKSYIQELSTIGVSDDERKASMNSVNPKYILRNYLCQSAIDAAEQDDFGEVRRLLKVMQRPFDEQPGMEKYARLPPAWAYRPGVGMLSCSS

SEQ ID NO: 136 - DNA, 1627 bp, Arabidopsis thaliana
ccgagattacagagaaccccgtcccgtgtttaaaccctccggcgacaaagctcagatagagaaccgctccacccttgtcgttcgctgcagccatgtacggcggagatgaagtgtcagctattgtggttgacttgggttcgcacacttgcaaggctggttacgccggtgaagatgctcccaaggccgttttcccttccgttattggggcagtagatggtgtagaggcaatggatgtggatgttgattctacaaagactaattcgaactctgaggattcgaagaccgagtctgaaaaggaaaagagcaaacgcaagctctatgtaggatctcaagccatgagctaccgcagagatcatatggaggttttgtcacctataaaagatggcatcgtttctgactgggatttggtggacaatatatgggaacatgctttcaagagttgtctgatgattgatcctacggagcatccaatgctgctagctgagcctcctttaaacactcaacagcagagagagaaggcggcagagctaatgtttgaaaagtacaaagttccggcactgtttatggctaagaaccctgttctcacgtcttttgctactgggcgtgctacttctttggttgttgactgcggtggaggatccacaaccatttcaccggtgcatgatggttatgttcttcagaaggctgttgtatcgtctccacttggaggggaatttctcactgactgcctactgaaaagcttggagagtaaaggaattaaaataagacctagatactctttcaagaggaaggaagtacgagcaggggaattccaggttgaagatgtggatattcctgacaccacggaaagctacaaactcttctgccagaggatgatagtgggtgatatcaaggattccatttgtcgagttcctgatactccctatgacgataaatcatattcaaacatccctactacgtcgtacgagcttcctgatggccagacgctcgagattggtgctgataggttcaaagttcctgatgtgatgttcaacccgtccatagtccagacgattcctggaatggagaagtatgctgagatgattccttccgttcgtgggttaccacacatggtcatggagagcatcaacaaatgtgatgtagacatccggagagagttgtatagtagcatactgcttgctggtggcacatcgtcaatgcaacagctgaaagaacgtctcgaaaaggacttgatcgaagagtctcctcactcagctagagttaaagtgttggcaagcggtaacacaacagaaagaagattcagtgtatggataggagggagtatattggcatcactaggctcatttcaacagatgtggttctccaagtctgagtatgaggaacatggagcttcctacattcagagaaaatgcccttaaagcaggcagtttcagattatgtggagtctgacaagacgaaacttggaaactaatgtgttattttcattgtgcatcgttgttccttgaagattattagtattccgcctgaaccttttagaatgagtgtcattaacaagcattatagtgctattttaaaaacataaaaacatgtggaagaagtttcgttgctttattagattttcgcacaa

SEQ ID NO: 137 - protein, 441 aa, Arabidopsis thaliana
MYGGDEVSAIVVDLGSHTCKAGYAGEDAPKAVFPSVIGAVDGVEAMDVDVDSTKTNSNSEDSKTESEKEKSKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYAEMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 138 - DNA, 1329 bp, Brassica napus
atgtacggcggagatgaagtgtcagctatagtggttgacttgggctcgcacacttgcaaggctggttacgccggcgaagatgctcccaaggccgtcttcccttccgttgttggggcggtagatggaagtgaggcgatggatgtggatgctgattctgcgaagaacaattcgaactcagaggattcgaagacgaacgagcctgacaaagaaaaggggaaacgtaagctgtatgtgggatctcaggccttgaattaccgccgagatcatatggagatattgtcacccatcaaagatggcatagtttctgattgggatttggtggacaacatttgggaacatgcgttcaggggttgtctgatgattgatcctaaggagcaccccatgctgctagctgagcctcctttaaacacccaacagcagagagagaaggcggcagagctaatgtttgaaaaatacaaagttccagctttgtttatggctaagaatcctgttctcacgtcttttgctactgggcgtgctacttcattggttgtggactgcggtggaggatccacaaccatatcaccggtgcatgagggttatgtccttcaaaaggcggttgtatcagctccaattggaggggagtttctcactgactgcttactgaaaagcttggagagtaaaggaatcaaaataaggcctagatactctttcaagagaaaggaagtacgaccaggggaattccaggttgaggatgtaggtgttcctgacaccacggaaagctacaagctcttctgtcagaggatgatagtgggtgatatcaaggattctatttgtcgtgttcctgatactccttatgacgacaaatcatatgcaaacatcccaactacgtcatacgagcttcctgatggccagacgctcgagatcggtgctgataggttcaagattcctgatgtgatgttcaacccgtcaatagttcagacaattcctgggatggagaagtatggagacatgattcctactgttcgtgggttgccacacatggtcatggagagcatcaacaaatgtgatgtggatatccggagagagttgtatagtagcatactgcttgctggtggcacatcatcgatgcaacaattgaaagaacgcctcgaaaaggacttgatagaagaatctcctcactcggctcgagttaaagtgttggcgagcggtaacacaacagaaagaagattcagtgtatggataggagggagtatattggcatcactgggctcattccaacagatgtggttctccaaatctgagtacgaggaacatggcgcttcgtacattcagagaaagtgcccttaa

SEQ ID NO: 139 - protein, 442 aa, Brassica napus
MYGGDEVSAIVVDLGSHTCKAGYAGEDAPKAVFPSVVGAVDGSEAMDVDADSAKNNSNSEDSKTNEPDKEKGKRKLYVGSQALNYRRDHMEILSPIKDGIVSDWDLVDNIWEHAFRGCLMIDPKEHPMLLAEPPLNTQQQREKAAELMFEKYKVPALFMAKNPVLTSFATGRATSLVVDCGGGSTTISPVHEGYVLQKAVVSAPIGGEFLTDCLLKSLESKGIKIRPRYSFKRKEVRPGEFQVEDVGVPDTTESYKLFCQRMIVGDIKDSICRVPDTPYDDKSYANIPTTSYELPDGQTLEIGADRFKIPDVMFNPSIVQTIPGMEKYGDMIPTVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 140 - DNA, 1338 bp, Glycine max
atgtatggcggtgatgaagtatcagctatagtagttgacttgggttcacacacttgtaaagctggttatgctggtgaagatgctcccaaggccgtgtttccctctgttgtgggagcaattgatcaaatggatgttgatgaagcagataatggcgaaaacaactctgcctctgctccggaatcaaataataatgttagaaatgctgattctgacaagaccaagggaaagaggaaattgtatgtaggatcccagtccttggggtaccgtagagaccatatggaggtgctgtctccgtttaaagacgggattgttgctgactgggatattgttgacagcatatgggatcacgccttcagggaatgcctattgattgatcctaaagagcatcctatgcttcttgcagagccttcttctaactctcaacaacagagagaaaggacagcagagctgatgtttgagaagtacaaagcacctgcattgtttttggcgaagaatgctgttctgacttcttttgcatcagggcgtgctacgtcattagttgttgatggtggtggaggatcaattacagttgcaccagtacatgatggttatgttcttcaaaaggctgtggctacctctccaatgggaggagaatttcttacagactgcttgatgaaaagcttggaaagcaagggtattacgataaaaccaaggtattcctttaggagaaaggaaatacgtcctggagagtttcagacagtagatcttgagtttccaaatacaactgaaagctacaaactctattgccagagggtgattgctagtgatatcaaggaatgtgtgtgtcgtgctccagatactccatatgatgagagtgcatattctaacatcccaatgacctcatatgagcttcctgatggccagacaattgaaattggagctgacagatttaagattccagatgttcttttcaatccgtccctggttcagtcaattcctggcacagagagctttgcagaaattgctccttcagttcgtggcctgcctcaaatggtgattgaaagcattaataagtgtgatgtagacattcgaagagagttgtttagtagtatactgcttgctggtggcacagcttcaatgcaacagctaaaggaacgccttgagaaagacttgctagaggagtcccctcaagctgccagagtaaaagtattagccagcggaaatgctactgaaagaaggtttagtgtttggattgggggtagtatattggcatcacttggctccttccagcaaatgtggttctccaaatccgagtatgaagagcatggagcttcatatatccaaaggaagtgtccatga

SEQ ID NO: 141 - protein, 445 aa, Glycine max
MYGGDEVSAIVVDLGSHTCKAGYAGEDAPKAVFPSVVGAIDQMDVDEADNGENNSASAPESNNNVRNADSDKTKGKRKLYVGSQSLGYRRDHMEVLSPFKDGIVADWDIVDSIWDHAFRECLLIDPKEHPMLLAEPSSNSQQQRERTAELMFEKYKAPALFLAKNAVLTSFASGRATSLVVDGGGGSITVAPVHDGYVLQKAVATSPMGGEFLTDCLMKSLESKGITIKPRYSFRRKEIRPGEFQTVDLEFPNTTESYKLYCQRVIASDIKECVCRAPDTPYDESAYSNIPMTSYELPDGQTIEIGADRFKIPDVLFNPSLVQSIPGTESFAEIAPSVRGLPQMVIESINKCDVDIRRELFSSILLAGGTASMQQLKERLEKDLLEESPQAARVKVLASGNATERRFSVWIGGSILASLGSFQQMWFSKSEYEEHGASYIQRKCP

SEQ ID NO: 142 - DNA, 1134 bp, Gossypium hirsutum
atggctgatggtgaggatattcaaccacttgtctgcgacaatggaactggaatggtcaaggctggatttgctggtgacgatgctccaagggctgtgttccctagcatcgtggggcgtccacgtcacactggtgtgatggttggtatgggtcaaaaagatgcatatgttggggatgaggctcagtccaaacgtggtattttaactctgaagtatccgattgaacacggtattgttaacaactgggatgatatggaaaagatttggcatcataccttttataatgaacttcgtgtggctccagaagaacatccggttcttcttaccgaggcacctcttaaccctaaagccaatcgtgagaaaatgacccaaatcatgtttgagaccttcaatgctccggctatgtatgttgctatccaggctgttctctccctatatgccagtggtcgtacaactggtattgttttggactctggagatggggtgagtcatactgtccccatatatgaaggatatgccctccctcatgccatcctccgtctcgacttagcgggtcgtgatcttactgatgcccttatgaaaatcttgactgaacgtggttattcattcaccactacagctgagcgtgaaattgtgagggatgtgaaagagaagctggcatatattgcactcgactatgaacaagagctagaaacttccaaaactagttcttccattgagaagagctacgagttgcctgatggccaagtgatcaccatcggcgctgagcgcttccgatgcccagaagtccttttccaaccttccatgattggaatggaagctgctggcattcatgaaaccacctacaactctatcatgaagtgcgatgtcgacattaggaaggatttgtatggaaacattgttctcagtggtggaactactatgttccctggaattgctgatagaatgagcaaggaaatcactgccttagccccaagcagcatgaaaattaaggtggtggctccacctgaaaggaaatacagtgtctggattggaggctccatcttagcatctctcagtactttccagcagatgtggattgctaaggcggagtacgatgaatccggcccctctattgtgcacaggaagtgcttctaa

SEQ ID NO: 143 - protein, 377 aa, Gossypium hirsutum
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDVKEKLAYIALDYEQELETSKTSSSIEKSYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 144 - DNA, 1134 bp, Hordeum vulgare
atggctgacgccgaggacatccagcccctcgtctgcgacaatggaaccggcatggtcaaggctgggttcgcaggagatgatgcgccaagggctgtcttcccaagtatcgtgggccgcccacgccacaccggtgtcatggtcgggatggggcagaaagacgcatacgtcggtgacgaggcccaatccaagaggggtatcctcaccctcaagtaccccatcgagcacggtatcgtcagcaactgggacgatatggagaagatctggcatcacaccttctacaacgagctccgtgtcgccccagaggagcaccccgtccttctcactgaggcgccgctcaaccccaaggccaatcgtgagaagatgacccagatcatgttcgagaccttcaacactcctgctatgtatgtcgccatccaggccgtcctctcgctgtatgccagtggtcgtaccacaggtattgtgctggactcgggagatggtgtcagccacactgtccccatctacgaaggatacgctcttccccacgctatcctccgtcttgacctggctgggcgtgatctcaccgattacctcatgaagatcctcactgagcgtggttactcattcaccaccactgctgagcgggaaattgtgagggatgtgaaggagaagctgtcctacattgcactggactacgaccaggaaatggagacttccaagaccagctcttctgtggagaagagctacgagcttcctgatgggcaggttatcaccattggttccgagcgtttccgttgccctgaggtcctcttccagccatccttcatcgggatggaagctgcaggtatccatgagaccacctacaactccatcatgaagtgtgacgtggatattaggaaggatctgtacggcaacattgttcttagtggtggtaccactatgttcactggaatcgctgataggatgagcaaggagatcactgccttggctcctagcagcatgaagattaaggttgttgctcctcctgaaaggaagtacagtgtctggatcggaggatccatcttggcatctctcagcaccttccagcagatgtggattgcaaaggctgagtacgacgagtctggcccatccatcgtgcacaggaaatgcttctaa

SEQ ID NO: 145 - protein, 377 aa, Hordeum vulgare
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDVKEKLSYIALDYDQEMETSKTSSSVEKSYELPDGQVITIGSERFRCPEVLFQPSFIGMEAAGIHETTYNSIMKCDVDIRKDLYGNIVLSGGTTMFTGIADRMSKEITALAPSSMKIKVVAPPERKYSVWIGGSILASLSTFQQMWIAKAEYDESGPSIVHRKCF

SEQ ID NO: 146 - DNA, 1920 bp, Medicago truncatula
atgtacgatggtgatgaagtttcagctatagtaattgatctgggttcacatacttgtaaagctggttatgctggtgaagatgctcccaaagctgtgtttccttctcgttattattattttgttctttttgtcgttgctgatgatagtgatgaagcgggcactgagattgaggccaattgcaagaaaccttttttgtggatcactaggcctaatcttgtcattggtggctcagtggttttgtcatctgagtttaggaaagaaatttcagatagaggcctaatatcaaattggtgtccacaagagaaagttttgaaccacccttcaatcagcgggttcttgactcactgcggatggaactcaaccaccgaaagcatatgcgctggagtgccaatgttgtgttggtcattttttgctgatcagccaacaaactgtagatttatttgtaatgaatggaagattggtatggaaattgatatgaatgtgaagatagaggatttggagaagcttatcaatgaattgatggtgggagagaatggaaaaaagatgaggcaaaaggccatggagttgaagaaaaaggcagaggagaacactagaccagatgaagtttcagctatagtaattgatttgggttcacatacctgtaaagctggttatgccggtgaagatgctcccaaagctgtgtttccttctgttgttggagcgattgatcaaatggacgtcgatgaatcagatgatgctgaaaagaactctggctctggtgaatcaaagaacaatattagaaatgttgacggtgataaagccaagggaaagagaaaattgtatgtaggatctcagtccttgggctaccgtagagattttatggaggtggtgtctccattaaaggatggaattgttgctgactgggatattgttgacagcatttgggatcatgccttcagggagtgtctactgattgatcctaaagagcatcccatgctccttgcagagccttcttctaatgctcaacaacagagagaaagggcagcagagcttatgtttgagaagtacaaagcacctgcattatttttggcaaaaaatgctgttttgacttcttttgcatcagggcgtgccacatcattagttgttgattgtggtggaggatcaactacagttgcaccggtacatgatggctatgttcttcagaaggctgtggcgacgtctccaattggaggagaatttcttacagattgcttgatgaaaagcttggaaagcaagggtattgcgatgaaacctcggtattcctttaggagaaaagaaatacgccctggagagtttcagactgtagacttggattttcctaatacgtctgaaagctacaagctctattcccagagggtgattgctagtgatatcaaggaatgtgtgtgccgtgctccagatactccatatgatgagagtgcatattcaaacatcccaacgacgtcgtatgagcttcctgatggccagacaattgaaattggagctgacagatttaagattccagatgttcttttcaatccatccctggctcattcaattccgggcatggagagctttgcagaaatcgctccatcagttcgtgggctgcctcaaatggttatcgatagcattaataagtgtgacgtagacattcgaagagaattatttagtagcatactgcttgctggtggcacggcttcaatgcaacaactgaaggaacgccttgagaaagacttgctagaggaatcccctcaggctgctagagtaaaggtattggccagtggaaatgctactgaaaggaggtttagtgtctggattggaggcagtatattggcttctcttggttccttccaacagatgtggttctccaaatccgagtatgaagagcatggagcttcatatatccaaaggaaatgtccttga

SEQ ID NO: 147 - protein, 639 aa, Medicago truncatula
MYDGDEVSAIVIDLGSHTCKAGYAGEDAPKAVFPSRYYYFVLFVVADDSDEAGTEIEANCKKPFLWITRPNLVIGGSVVLSSEFRKEISDRGLISNWCPQEKVLNHPSISGFLTHCGWNSTTESICAGVPMLCWSFFADQPTNCRFICNEWKIGMEIDMNVKIEDLEKLINELMVGENGKKMRQKAMELKKKAEENTRPDEVSAIVIDLGSHTCKAGYAGEDAPKAVFPSVVGAIDQMDVDESDDAEKNSGSGESKNNIRNVDGDKAKGKRKLYVGSQSLGYRRDFMEVVSPLKDGIVADWDIVDSIWDHAFRECLLIDPKEHPMLLAEPSSNAQQQRERAAELMFEKYKAPALFLAKNAVLTSFASGRATSLVVDCGGGSTTVAPVHDGYVLQKAVATSPIGGEFLTDCLMKSLESKGIAMKPRYSFRRKEIRPGEFQTVDLDFPNTSESYKLYSQRVIASDIKECVCRAPDTPYDESAYSNIPTTSYELPDGQTIEIGADRFKIPDVLFNPSLAHSIPGMESFAEIAPSVRGLPQMVIDSINKCDVDIRRELFSSILLAGGTASMQQLKERLEKDLLEESPQAARVKVLASGNATERRFSVWIGGSILASLGSFQQMWFSKSEYEEHGASYIQRKCP

SEQ ID NO: 148 - DNA, 1332 bp, Oryza sativa
atgtacggcggcgatgaggtctcggccatcgtcatcgacgtggggtcctacagctgcaaggcggggtacgccggtgatgacacccccaaggccgtcttcccctcggttgttggttcaattgagcaaacgggagaaactgatgaagcaaaggcagacaaggaggctgaagctgcatcagattctaagaatggagccaaacctatggatgtggacaaagccaagacaaagcgcaaattgtatgttggtcaagaattggagttcaggagggatcatatggaggtgatttcaccaatgaaagatggaacagttactgattgggatattgttgacaatatatggaatcatgctttcaggcagcggctattgatcaatcctgaggagcatcctatgttgatagctgaaccatctacaaacacaggacagcaaagagagaaagcagcagaacttatgtttgagaagtacaaagtgccggcactgttcctagcgaaaaatgcagttctcacatcttttgcatctggacgtgctacatcgttggtagttgacagcggtggtgggtctactgtggttgctgctgttcacgatggttatgtattgcaaaagtctgtggcgacttctccaattggtggtgaatttttaactgactgtatgatgaaaagcttggagagcaagggcgttgttataaggcccaggtattcattcaagaagaaggaagtcggccctggcgaatataaggttgtagatcttgatcttccaaacacaacggagagttacaagttatactgcatgagagctattgctagtgatatcaaggagtcagtttgcagggttccagatactgccttcgatgaagtggcatatgcaaacgttcctacaacttcatatgagcttccagatggacaaaccattgaagttggtgcagacagattcaagattcctgatattctgtttaatccatctctttctcagactattcctggagttgatggatttgcagattcaatgtcagttcgtggccttccacgaatggtcattgatagtgtaaataggtgcgatgttgacattcgcaaggaactgctaagcagtattctgctttcaggtggttcatcatcaattctgcagttgaaggagaggctagaaaaagaagtacttgaggaatcttctggtaatactcgtgtaaaggttttggcaagtggaaattcagtagagaggcgattcagtgtttggattggagggagcattctagcatcccttgggtcgttccagcaaatgtggttctccaaagcagaatacgaagaacatggagtatcctacatccaaaggaagtgcccatga

SEQ ID NO: 149 - protein, 443 aa, Oryza sativa
MYGGDEVSAIVIDVGSYSCKAGYAGDDTPKAVFPSVVGSIEQTGETDEAKADKEAEAASDSKNGAKPMDVDKAKTKRKLYVGQELEFRRDHMEVISPMKDGTVTDWDIVDNIWNHAFRQRLLINPEEHPMLIAEPSTNTGQQREKAAELMFEKYKVPALFLAKNAVLTSFASGRATSLVVDSGGGSTVVAAVHDGYVLQKSVATSPIGGEFLTDCMMKSLESKGVVIRPRYSFKKKEVGPGEYKVVDLDLPNTTESYKLYCMRAIASDIKESVCRVPDTAFDEVAYANVPTTSYELPDGQTIEVGADRFKIPDILFNPSLSQTIPGVDGFADSMSVRGLPRMVIDSVNRCDVDIRKELLSSILLSGGSSSILQLKERLEKEVLEESSGNTRVKVLASGNSVERRFSVWIGGSILASLGSFQQMWFSKAEYEEHGVSYIQRKCP

SEQ ID NO: 150 - DNA, 1317 bp, Physcomitrella patens
atgtacgggggagatgaggtttcggcgatagtgctggaccttggttcacactcctgcaaagcaggttatgcaggtgaagatcaacccaagtctgtattcccatctgtagtaggctcagtggagaccccaggagcggtggtcgatgggggaggagacacagacatggaggctaagaagtctggagaagccgaaaaggctaagtcgaggaaactgtatgctggtgtgcaagctctgggttatcgcagagattacatggaggttgtaccggctatgaaggatggcctcgttgcagattgggatgttgtagaaagtctttgggatcacgctctaagggatcgtttaatgatagacccaaaggagcatccaatgcttctcgcagagccctcattcaacacacaacaacatcgcgaaaaaatggttgaacttatgttcgagaagtacgacgtaccagccctttttctcgccaagaatgcggttttgacatcctttgcatcaggccgagcaacatcgctcgttgtggactgcgggggaggctcaaccaccgtggctgcagtgcatgacggttatgtccttcagaaggctatagttcgatcggcaattggaggggaagttctcacagattgcctccaacgaacattggaagccaaaggcattaagatcaaaccacgtttctcatttaagcgcaaagagatacgtcagggggaatacgagttgatcccactcgatcttccaaacacgacagacagctactacgcttatgcgcagagagctattgtggctgatattaaagaatccatttgccgtgtaccagattcagcttttgatgaaacttcatatgctaatatcccaacaacaccttatgagcttccagacggccagataattgaaattggagctgatcgtttcaagatttcagacattttgttcaatcctactcttattcagacaattcctggcatggagaaattcggcactgaagctggaataccttttaacggacttcctcaaatggtgattgagagcatcaacaaatgtgatgttgatatacggagagagctcttcaacagtgtgatgcttgccggtgggactgcttctatgcatcagatgaaggagaggctagaaaaggatctcatggaagaggcaccacaagctgcacgtgtgaaagtgttggccagcggtaacgtcttggagcgtcgattcagtgtatggattggtggaagtattttggcttcattgggctcttttcagcaaatgtggttctccaaagcagagtatgaagagcatggtcccacatatgttcagagaaagtgcccataa

SEQ ID NO: 151 - protein, 438 aa, Physcomitrella patens
MYGGDEVSAIVLDLGSHSCKAGYAGEDQPKSVFPSVVGSVETPGAVVDGGGDTDMEAKKSGEAEKAKSRKLYAGVQALGYRRDYMEVVPAMKDGLVADWDVVESLWDHALRDRLMIDPKEHPMLLAEPSFNTQQHREKMVELMFEKYDVPALFLAKNAVLTSFASGRATSLVVDCGGGSTTVAAVHDGYVLQKAIVRSAIGGEVLTDCLQRTLEAKGIKIKPRFSFKRKEIRQGEYELIPLDLPNTTDSYYAYAQRAIVADIKESICRVPDSAFDETSYANIPTTPYELPDGQIIEIGADRFKISDILFNPTLIQTIPGMEKFGTEAGIPFNGLPQMVIESINKCDVDIRRELFNSVMLAGGTASMHQMKERLEKDLMEEAPQAARVKVLASGNVLERRFSVWIGGSILASLGSFQQMWFSKAEYEEHGPTYVQRKCP

SEQ ID NO: 152 - DNA, 1326 bp, Populus trichocarpa
atgtacggtggtgatgaagtgtcagctatagtcattgacttgggttctcacacttgcaaagctggttatgccggcgaggacgcacccaaggccgtctttccttctgttgtgggatcaattgatcaaatggatgttgatgacatgacaagcaacgagaagaatgctgctgtagattctaaaaataatgtcaaagattctgagaaagggaagggaaaacgtaaattatttgtaggatctcaggccttagggtttcgtcgggaccatatggaggtgttatccccttttaaggatgggattgttgctgactgggatattgtggatagcatatgggatcatgctttcagggagtgtctattgattgatccaaaggagcatccaatgctacttgcagaaccttcatccaacagtcaacaacagagagaaaggacagcagagcttatgtttgaaaagtacactactcctgcattatttttggcgaagaatgctgttttaacatcttttgcatcaggacgtgctacctcgctagttgttgatagtggtggaggatcaactacaattgcaccagtccatgatggttatgttattcaaaaggctgtggccttttctcctattgggggagaacttcttactgattgcttgatgaaaagcttggagagcaaaggtgtcatgataaaaccaaggtactctttcaaaaggaaggaaatacagccgggcgtgtttcagactgtggatcttgattttacaaatacaactgacagctacagactctactctcagagagtgattgcaagtgatatcaaggaatgtgtgtgtcgtgcaccggatacgccctatgatgaaagttcatactcaaacattccaatgactccatatgagcttccggatggccagacaattgaaattggagctgatagattcaagattccagatattctattcaatccatccttggtccagacaattcctggtatggataattttgtggagattgctcctagtgttcgcggtttgccacaaatggttattgaaagcattaataagtgtgatgttgatattcgaagagaactgttcagtagtatactgcttgctggtggaacagcatcaatgcaacagttgaaggaacggcttgagaaagatttgcttgaggagtctcctcaagctgccagagttaaagtgctggctagtggaaatgcaactgaaaggagattcagtgtctggataggagggagtatattggcatctcttggttcattccagcagatgtggttctccaaggccgagtatgaagagcatggggcgtcttatgtacagagaaaatgcccttga

SEQ ID NO: 153 - protein, 441 aa, Populus trichocarpa
MYGGDEVSAIVIDLGSHTCKAGYAGEDAPKAVFPSVVGSIDQMDVDDMTSNEKNAAVDSKNNVKDSEKGKGKRKLFVGSQALGFRRDHMEVLSPFKDGIVADWDIVDSIWDHAFRECLLIDPKEHPMLLAEPSSNSQQQRERTAELMFEKYTTPALFLAKNAVLTSFASGRATSLVVDSGGGSTTIAPVHDGYVIQKAVAFSPIGGELLTDCLMKSLESKGVMIKPRYSFKRKEIQPGVFQTVDLDFTNTTDSYRLYSQRVIASDIKECVCRAPDTPYDESSYSNIPMTPYELPDGQTIEIGADRFKIPDILFNPSLVQTIPGMDNFVEIAPSVRGLPQMVIESINKCDVDIRRELFSSILLAGGTASMQQLKERLEKDLLEESPQAARVKVLASGNATERRFSVWIGGSILASLGSFQQMWFSKAEYEEHGASYVQRKCP

SEQ ID NO: 154 - DNA, 1308 bp, Solanum lycopersicum
atgtacggtggtgatgaagtgtcagcaattgtgatagatttgggtagccatacttgcaaagctggttacgctggggaagatgctcccaaagccgttttcccatctgctgttggatcggttgatgaaatggaagttgataatcctgataatccagaggataattctggatctgctcctgaccttaaatcaaagggtaagcggaaattgtatgttggatctcaagccttgggatttcgccgtgatcacatggaggtgatatcacccatcagggatgggatggttgtggactgggatattgtagaaaacatatgggaccatgcttttagggaatgcttactgatcgatccaaaggagcatccaatgttacttgcagagccttgttcaaacactcagcagcagagggaaaaggctgcagagataatgtttgaaaaataccaagttccagcattgtttttggccaaaaatgctgttctcacatctttcgcatcaggacgtgcaacttctttggttgttgacagtggtggaggattgactactgttgctccggttcatgatggatgcgttcttcaaaaggcggtttgtacatctcctattgggggtggaattcttaccgattgcttgataaaaagtttggaacagaaaggcattacgataaaacctaggtattcattcaagcggaaggagatccgtccaggagaatttcagacagtggaccttgatttccctgatacaaccgagagttacaagctatattgtcagagagcgattgcaagtgacataaaagaatgcgtctcccgagccccagatactccatatgatgacagttcatattcgaacattccaacgacatcttatgagctacctgatgggcagataatagaagtcggagcagatagattcaagattcctgatattatattcaatccatcattggttcagactattcccggtatggaaagttttgctgaaactgccgcttcccttcgtggtcttccacaaatggttatagatagcataaacaagtgtgatgtggatattcgaagagaactttttagcagtatattgcttgctgggggaacagcatcgatgcaacaactcaaagaacgtctggagaaggacttgctagaggagtctcctcaggcagcgagagtcaaagtcctggctagtggaaatgctacagaaaggagattcagtgtttggatagggggcagcattctggcatctcttggctcctttcaacaaatgtggttttcaaagtccgagtacgaagagcatggggcatcttacgttcaaagaaaatgcccttaa

SEQ ID NO: 155 - protein, 435 aa, Solanum lycopersicum
MYGGDEVSAIVIDLGSHTCKAGYAGEDAPKAVFPSAVGSVDEMEVDNPDNPEDNSGSAPDLKSKGKRKLYVGSQALGFRRDHMEVISPIRDGMVVDWDIVENIWDHAFRECLLIDPKEHPMLLAEPCSNTQQQREKAAEIMFEKYQVPALFLAKNAVLTSFASGRATSLVVDSGGGLTTVAPVHDGCVLQKAVCTSPIGGGILTDCLIKSLEQKGITIKPRYSFKRKEIRPGEFQTVDLDFPDTTESYKLYCQRAIASDIKECVSRAPDTPYDDSSYSNIPTTSYELPDGQIIEVGADRFKIPDIIFNPSLVQTIPGMESFAETAASLRGLPQMVIDSINKCDVDIRRELFSSILLAGGTASMQQLKERLEKDLLEESPQAARVKVLASGNATERRFSVWIGGSILASLGSFQQMWFSKSEYEEHGASYVQRKCP

SEQ ID NO: 156 - DNA, 909 bp, Triticum aestivum
atgtacggcggcgacgaggtctcggcgatcgtcatcgacgtgggctcctacagctgcaaggcgggctacgctggcgacgacacccccaaatgcgtcttcccctcggttgttggttcaattgaacaaacgggagatactgatgaagctaagccagaaaaggaggccgactctggatcagatcctaagaatggatccaagcctatggatgtggacaaagccaagacaaagcgcaaattttatctaggccaagaattagaattcaggagggatcatatggaggtgatctcaccgctgaaagatggaacagttattgattgggaagttgttgacaacatatggaaccatgcttttagacggcggctattgatcaatcctgaagagcatcctatgctgatagcagaaccatctacaaacagtggacagcaaagagagaaagcagccgaacttatgtttgagaagtacaaagtgccagcgctgttcctagcaaaaaatgcagttctcacatcttttgcatctggacgtgctacatctctggtggttgactgtggtggcgggtctactgtggtttctgctgtgcatgatggttatgttttgcaaaagtctgtggcaacttctccgattggcggtgaatttttgactgactgtatgatgaaaagcttggagagcaagggcgttgttatcaggccccgggattccttcaagaagaaggaagtgagccctggagattataaggttgtagaccttgattttccgaacaccacggatagttacaggttgtaccacatgagagctattgctagcgacatcaaggagacggtttgtagagttccagatactcccttcgatgaagtggcatatgcaaatgctcccacaacttcatacgagcttccagacgggcaaactatttga

SEQ ID NO: 157 - protein, 302 aa, Triticum aestivum
MYGGDEVSAIVIDVGSYSCKAGYAGDDTPKCVFPSVVGSIEQTGDTDEAKPEKEADSGSDPKNGSKPMDVDKAKTKRKFYLGQELEFRRDHMEVISPLKDGTVIDWEVVDNIWNHAFRRRLLINPEEHPMLIAEPSTNSGQQREKAAELMFEKYKVPALFLAKNAVLTSFASGRATSLVVDCGGGSTVVSAVHDGYVLQKSVATSPIGGEFLTDCMMKSLESKGVVIRPRDSFKKKEVSPGDYKVVDLDFPNTTDSYRLYHMRAIASDIKETVCRVPDTPFDEVAYANAPTTSYELPDGQTI

SEQ ID NO: 158 - DNA, 1332 bp, Zea mays
atgtacggcggagacgaggtttcggcaatcgtcatagatgtgggctcttacagctgcaaggcgggctacgcaggcgacgacacccccaaggccgtcttcccatcggttgttggttcaattgaacaaactgaagacacagatgaccccaagccagagaaggaagctgactctgcatcagattctaagaacggtgccaagcccatggatgtggacaaagccaagacaaaacgcagactttatgtaggccaagagttagagttcaggagggatcacatggaggtgatttcatctatgaaagatggaacggtaactgactgggatattgttgataatatatggaatcatgctttcagacggaggttgttgatcaatcctgaagagcatcctatgctcattgctgaaccatctacaaacactgcacagcaaagagagaaagcagcggaacttatgtttgagaactacaaagtgccagcgctgtttctagccaaaaatgcagtgctcacatcttttgcgtctggacgagctacatctttggtggttgacagtggtggtgggtctactgtggtttctgctgtacacgatggttttgttttacagaagtctgtgtcgacttctccagttggcggtgaatttttaactgactgtatgatgaaaagcttggagagcaagggcatcgtcattaggcccagatattcatttaagaagaaggaaatcagtcctggagaatataagattgtagatcttgatcttccaaacacaactgagagttacaggttgtactgcatgagagctattgctagtgacgtcaaggagtctgtttgcagagttccagacactgcttttgatgaagtggcatatgcaaatgttcctacaacttcatatgagcttcctgatggacaaactattgaagttggtgctgatagattcaaggttcctgatattctatttaatccatctctatcccagactattcctgggattgatggatttgcagattcaataccagtccgtggccttcaacgaatggtcattgatagcgtaaataagtgcgacgttgacatacgaaaagagctattcagtaacatcttgctctctggtgggtcatcatcaattctgcagttaaaggagcgcctggagaaagaagtattggaggagtctcctcaagctgctcgtgtcaaggttatggcaagcggaaactcagtagagagacgtttcagtgtttggattggagggagcattctagcatctcttgggtcgttccagcagatgtggttctccaaagcagagtatgaagagcatggggtttcctatattcagagaaagtgcccttga

SEQ ID NO: 159 - protein, 443 aa, Zea mays
MYGGDEVSAIVIDVGSYSCKAGYAGDDTPKAVFPSVVGSIEQTEDTDDPKPEKEADSASDSKNGAKPMDVDKAKTKRRLYVGQELEFRRDHMEVISSMKDGTVTDWDIVDNIWNHAFRRRLLINPEEHPMLIAEPSTNTAQQREKAAELMFENYKVPALFLAKNAVLTSFASGRATSLVVDSGGGSTVVSAVHDGFVLQKSVSTSPVGGEFLTDCMMKSLESKGIVIRPRYSFKKKEISPGEYKIVDLDLPNTTESYRLYCMRAIASDVKESVCRVPDTAFDEVAYANVPTTSYELPDGQTIEVGADRFKVPDILFNPSLSQTIPGIDGFADSIPVRGLQRMVIDSVNKCDVDIRKELFSNILLSGGSSSILQLKERLEKEVLEESPQAARVKVMASGNSVERRFSVWIGGSILASLGSFQQMWFSKAEYEEHGVSYIQRKCP

SEQ ID NO: 160 - DNA, 1215 bp, Glycine max
atggggaagaaaacagagctgaaagatcacaaggagatagccaaagttgaaactgttcttgagcttctcaggaaacaaacccctctcactgtgaaacaggagaagttttgcaactatgcttgtgtgaaacggtttctgaaagcaaaaggggatagtgtgaaaaaagcttcgaagcaactcaaggcttgtcttgcttggagagagagtgttatcgctgatcacttgatagcagatgatttctcagctgaactggctgatgggttggcctatttggctggtcatgatgacgaatccagacctgttatgatttttcgtttgaagcaagattatcaaaagttgcattcccagaagatgttcactcgtttgctggcctttacaatagaggtggccatttcgaccatgccaaaaaacgtagaacaattcgtgatgctttttgacgcaagcttttacagatcagcatctgctttcatgaacctattactaccagcactgaaaattgtggcggagtactacccaggaaggctatgcaaagcgtttgtcatagaccctccctcgcttttcgcttacttgtggaagggtgtgaggccgttcgtggaattatcatcatggacgacggtggtatcatcgttggatttcgaagaatcgttggacttcaacgacttcgcggcgtacccgcgagcctcgtccctccgattcgacagcgcgagcgtgaaatcaacggcgaagataggctcgtgctcctcgtcacggttctccttcaccgtatctcaccaccttgactcgttgaagccctggtacctgagcctggccgacacgtcagcatccaaagtgggacccacgagtccttcggccgcactcatctcgccgctgaacgcgcgctcgctctcgttcgcgtcgcccgtcgcgagaaccccccgaggccccccggccaccaggaagggcctcttcccctcaacgccgctgccgcagcgcgtgacggcgccgccgcggacctcgttcctccagtcgccggcgacgttcttcaggcgagatagccacgttgccgccaagggagagaggtgccgggaatcgttcttgccgtatgtgaagttctaccgaagaccatacgacgaaatggtgtataggtcaaagatgcggcccccactcggcggcctaatctccattgtttcccctcatatcacaagacgccatgtttccgtttctcagcgtttctaa

SEQ ID NO: 161 - protein, 404 aa, Glycine max
MGKKTELKDHKEIAKVETVLELLRKQTPLTVKQEKFCNYACVKRFLKAKGDSVKKASKQLKACLAWRESVIADHLIADDFSAELADGLAYLAGHDDESRPVMIFRLKQDYQKLHSQKMFTRLLAFTIEVAISTMPKNVEQFVMLFDASFYRSASAFMNLLLPALKIVAEYYPGRLCKAFVIDPPSLFAYLWKGVRPFVELSSWTTVVSSLDFEESLDFNDFAAYPRASSLRFDSASVKSTAKIGSCSSSRFSFTVSHHLDSLKPWYLSLADTSASKVGPTSPSAALISPLNARSLSFASPVARTPRGPPATRKGLFPSTPLPQRVTAPPRTSFLQSPATFFRRDSHVAAKGERCRESFLPYVKFYRRPYDEMVYRSKMRPPLGGLISIVSPHITRRHVSVSQRF

SEQ ID NO: 162 - DNA, 1218 bp, Medicago truncatula
atggggaagaaacttgaactcctcaaagacaaggaaactgctaaagttgaagctgttcttgaactcatcagaaaacaaacccctctcactgtcaaacaggaaaagttctgcaactatgcttgtgtgaaacggtttctgaaagtgaaaggagataatgtgaaaagagctgctaaacaactaagagcttgtctttcatggagagaaagtattgttactgatcaattgatagcagatgatttctcagctgaattatctgaagggttggcttatgtggctggtcatgatgatgaatccagacctgttttgattttccgcatgaaacaagactatcagaagttgcattctcagaaactgttcttcactcgtttattggctttcacaatggaagtggcaatttcaaacatgccaaaaaatgttgaacaatttgtcatgcttttcgatgcaagcttttacagatcagcatctggatttatgaacttgttgttgggagcattgaaaattgtgggtgagtactatccaggacggttaagcaaagcatttgtgatagaccctccatcactttttgcatacttgtggaagggtgttcgtccattcgttgagctatcaacatgcacaacaatagtatcatccctagatttcgaaccatcaatggactacaacgacttctcaacttacccaagagcctcatcactcagattcgatcaatcaacggcgaagatcggttcatgctcatcctcacgcttctccttccaagtctcacaccaactcgactcactgaaaccatggtaccttagcctaggaggagacaacacatcatcctccaaagtaggacccactagcccatcccttacaccactcaacgctcgctcactctcattcgcttcaccaatagcacgcaacccactgggcccaccagctagcaggaaggggttgttcccttcaacaccactgccgcagagagtgactactgctcctaaccggactacggcggcgtcgtttcttcagtctccggcgacgtttttcaggcgggatagggataatgtgaaggtggaaagaggtagagaaacatttttggcgtatgtgaaattctatagaagggcgtatgatgaaatggtttataggtcaaagatgaggcccccacttggtggattagtctccattgtttcacctcatcttagacgccgtcacactcacctttctgtttctcagcgtttctaa

SEQ ID NO: 163 - protein, 405 aa, Medicago truncatula
MGKKLELLKDKETAKVEAVLELIRKQTPLTVKQEKFCNYACVKRFLKVKGDNVKRAAKQLRACLSWRESIVTDQLIADDFSAELSEGLAYVAGHDDESRPVLIFRMKQDYQKLHSQKLFFTRLLAFTMEVAISNMPKNVEQFVMLFDASFYRSASGFMNLLLGALKIVGEYYPGRLSKAFVIDPPSLFAYLWKGVRPFVELSTCTTIVSSLDFEPSMDYNDFSTYPRASSLRFDQSTAKIGSCSSSRFSFQVSHQLDSLKPWYLSLGGDNTSSSKVGPTSPSLTPLNARSLSFASPIARNPLGPPASRKGLFPSTPLPQRVTTAPNRTTAASFLQSPATFFRRDRDNVKVERGRETFLAYVKFYRRAYDEMVYRSKMRPPLGGLVSIVSPHLRRRHTHLSVSQRF

SEQ ID NO: 164 - DNA, 1317 bp, Oryza sativa
atggccatggagaaggtggacgccaaggagagggagaagatcgaggccgtccgcaagaccctccgcaagcaggctccgctcaccgccaagcaggcgatgtactgcaacgacgcgtgcgtggagcggttcctccgggcgagaggggagagcgtgaagaaggcggcgaaacacctgagaaccgtcctgtcctggagggacaccatcggagccgatcacatcatcgccgacgagttctccgccgagctggctgacggcgtcgcctacgtcgccggccacgacgacgaggcccgacctgtcgtggtctttcgaatcaagcaggactacccaaagttccactcccagaaatcgttcgtgcggttactggtgttcacgctggaggtggccgtgtcatgcatgtcccgcttcgtcgaccagttcgtcctcctcttcgatgcaagctttttccggtcggcgtcggctttcctcaacctgctcatgggcacgctcaagatcgtcgccgactactaccccggccgcctccaccgcgccttcgtcatcgacccgccgtccctcttctccgtcctctggaagggagtgaggccgttcgtggagctggcgccggcgacggcggtggtgtgctcgctggacttcgaggactcgctggaggacgcgtcgttcacggcgtacccgcggacggcgtcgctgcggttcgagccggcggcggccctgctggcgaccgggacgaagggcatcggcgtcggctccgcctcgtcgcggttctccgtcaccgtgtcgcacgacaacaccctcaagccgtggtacctgtccaccaccacgccgtcgtcggtggggcctcgctccgtggtgccgacctccagcccgtccctcatcggcgcgtcgccgctctcggcgcgctccttctccttcgcctcccccgccgcgcgctccaccacgacgccgcccgtccaccgcggcgcaccgctgacgccgttctcgaccaagggcgggcagaaggcgccggcgccagcgcagcagttcccgcggacgccgcggccgtcgttcctgcagtcgccgtcgatgctgttcgcgttcaagaaggacggccaggccagccgcggcgagcgggagcgcgagtccttcctgccgttcctccgcttctaccgccgcccctacgacgagatatcgtatcgcgccaagatgcggccgccgctgggcgggctcatcgccatcgtcgacgagaagtcgaagcagcacaagacggtgcagccgccgctgcgacggcacgccgggctccaccaccagcagctgttccagctccaccaccaccagaggatctga

SEQ ID NO: 165 - protein, 438 aa, Oryza sativa
MAMEKVDAKEREKIEAVRKTLRKQAPLTAKQAMYCNDACVERFLRARGESVKKAAKHLRTVLSWRDTIGADHIIADEFSAELADGVAYVAGHDDEARPVVVFRIKQDYPKFHSQKSFVRLLVFTLEVAVSCMSRFVDQFVLLFDASFFRSASAFLNLLMGTLKIVADYYPGRLHRAFVIDPPSLFSVLWKGVRPFVELAPATAVVCSLDFEDSLEDASFTAYPRTASLRFEPAAALLATGTKGIGVGSASSRFSVTVSHDNTLKPWYLSTTTPSSVGPRSVVPTSSPSLIGASPLSARSFSFASPAARSTTTPPVHRGAPLTPFSTKGGQKAPAPAQQFPRTPRPSFLQSPSMLFAFKKDGQASRGERERESFLPFLRFYRRPYDEISYRAKMRPPLGGLIAIVDEKSKQHKTVQPPLRRHAGLHHQQLFQLHHHQRI

SEQ ID NO: 166 - DNA, 2016 bp, Physcomitrella patens
atggatcaatggcaagtgtgtgttacttatcatgtcgatgcgggctgtgctattaacgccattagaatcatgtcaatgcggaacttgtcatttataaggcgggatgaggtgccgatcgcatgcttgactggttttggtgaccgtcttttcgtggtggtgtcggtttctgttttggctgtgggttgttttcttgtcaactgttgtgccactttcccgagctgtgatcgttacgggcggcgttgcggaagatattgtgtttttggttgcgtttgcgttgcgatggagtgtcttgttgatagcagctttttgttgatggtgctgctgaatgttgtcagatcgttgatgtgtgtacgagttgcgggtcgggggaggtcattattattggttcctggtacttttatctcttcctggtgctgcgatgcttggctttcttgcatactgacggtcaactttctagaatggcactctgggcttagcgcagtgccaaaggcagtggaggaggttcctagaggacaccggagttgtgtaggagggctagagtgggattcatttggggacattggagcgacgcgggaaaatagaagggatagtttggaagtaaggaacatggagcaggaactagttgcagtggctgcttcccctgctaaagtggagccagaatcgactacaaaggagaagcggaaagaagtgctacagctcgtccaaaaagataacccccttaccaagaaagagttggacttttgtgatgacgcctgcgtagaccggtatttaaaagcttgtggaaacagtgtgcggcgggctgcgagaatgctcaaagctacccttaactggcgtgacaaaatcgaaattggctacatgatagcggacgaatttccagctgacatagccgcaggatctgcttatgtagctggtcatgacgaagacggtcgaccagtcttggttatcaagaggaagcccgatcacatcttgaatcatactcaaaaacaatatcttcgatatctgatcttcacaatggaagtagcgctggctgcaatggctccaggagtttatcaatgggtgcttatttttgatgctcgaggatattcaaaagctagcgctccatcacctagtggcattctcacgactttgaagatactctcagatcattatccagagaggctggcgaaggctttcattgtagatgcttcatccatgttttatcatatttggaaggggatgtgtacttttgttgaccatcccacgagagggaaattacattttgcctacaccaaagattacaaaggaactttaaaatcacagcagagctccaaagctgttcctttgtctccgtcttctgacagtgctccgcgaagatcatcaaatgcttgtgccgacgatttcaaatatcttacgtctcctcagtccactgtacaaggccgaaatgacatatctctaccaacagtttatgatgctagtccgaagaacaattgtcaagggcaaactcgtggcaagctgtcagatggccctgaattaattcacagtgttcggacaagatctttctcattctcctcgatcattaccatgtcttacactgcacctgaaccacgagatggtgaatcctctagttttaggaaagaaccagaagagatagttgacgaaccaaaagttgtggtcacgtcatctgttagaccaaaactcaccagagcaccctgggatggccttgtttccatattttactcgcagaagaaggacgaacacaagaagcagaatctttcacggaaggaggaagaacccgtggcattggacgaaccgacgaaggatgaattcaaaaaagaggaacacagaaaagacgacaacgtgaaagaagaacagaggagggatgaacagaaaattaggtccctagattcttttctgccatacttaagttttgtccaggaaccttacaatgaagaatcatatagggcattgatgaagcctccccttggtgggctggccatgataatttctactgaactaaacagtatggacagcttctaa

SEQ ID NO: 167 - protein, 671 aa, Physcomitrella patens
MDQWQVCVTYHVDAGCAINAIRIMSMRNLSFIRRDEVPIACLTGFGDRLFVVVSVSVLAVGCFLVNCCATFPSCDRYGRRCGRYCVFGCVCVAMECLVDSSFLLMVLLNVVRSLMCVRVAGRGRSLLLVPGTFISSWCCDAWLSCILTVNFLEWHSGLSAVPKAVEEVPRGHRSCVGGLEWDSFGDIGATRENRRDSLEVRNMEQELVAVAASPAKVEPESTTKEKRKEVLQLVQKDNPLTKKELDFCDDACVDRYLKACGNSVRRAARMLKATLNWRDKIEIGYMIADEFPADIAAGSAYVAGHDEDGRPVLVIKRKPDHILNHTQKQYLRYLIFTMEVALAAMAPGVYQWVLIFDARGYSKASAPSPSGILTTLKILSDHYPERLAKAFIVDASSMFYHIWKGMCTFVDHPTRGKLHFAYTKDYKGTLKSQQSSKAVPLSPSSDSAPRRSSNACADDFKYLTSPQSTVQGRNDISLPTVYDASPKNNCQGQTRGKLSDGPELIHSVRTRSFSFSSIITMSYTAPEPRDGESSSFRKEPEEIVDEPKVVVTSSVRPKLTRAPWDGLVSIFYSQKKDEHKKQNLSRKEEEPVALDEPTKDEFKKEEHRKDDNVKEEQRRDEQKIRSLDSFLPYLSFVQEPYNEESYRALMKPPLGGLAMIISTELNSMDSF

SEQ ID NO: 168 - DNA, 1284 bp, Populus trichocarpa
atgggcaagaaagaacagcaacttcaaccacagaaagatcacaaagacaatgatagaggtgaagctgttctcgagcttctaagaaaacatgctccactcactgttaaacaggagaagttctgcaacaatgcttgtgtggagaggtttctaagagcaaaaggtgataatgtgaagaaagctgctaagcacttaagggcctgcctttcttggagagagagtataggcactgagaatttgatagcggatgagttctcagctgagctagctgaaggagttgcttatgttgctggtcatgatgaagaatccagacctgttatgatttttcgaatcaagcaagattaccaaaagttccattcacaaaaactgttcactcggttgctagtgtttacactggaggtggcaatagggaccatgccaagaaacgcagaacaatttgttctcctctttgatgcaagctttttcaggtcagcatcggcttttatgaatttattgctcggaactctgaaaattgtggctgagtactacccaggcaggctttacaaggcttttgtaatcgacccgccttctctcttcccttatttatggaagggtgtccgtccatttgttgagctatcaacggccacgatggtggtatcttcactagactttgaagaatcactggagttcaatgacttttcctcctaccctcgagcctcctccctccgattggatccttcgtctgtcaagtcaacggctaagattggctcatgctcttcctctagattttccttcaccgtgtcccaccattttgactccctcaagccttggcacctaactttgactgacacgtcggcatcaaaagtaggaccaacaaacctctcttctctgggcccggccctcatctctcccctcaacgctagatccttttcttttgcgtcaccagttgccagaaccccacgtggcagcatgaacggtggcagctacactaggcttgcccagaaaagtctcttcccatcaaccccgttgccacagcgtgtcaccacgagtgacacactcaaaatctctcaaccgcggaccccacgcccctcgttcctccaatcacctgccttgtttttcaagaaggagtgccacgtcagcaaggcagacaggtctcgagaatcgttcgtgccatttttgaagttttataggaggccgtacgatgagatgatttataggtcaaagatgcggcctccactcgggggactcatatccattgtctcgcctcacatcaaacggcgccacatgtcagtatctcaacggttttaa

SEQ ID NO: 169 - protein, 427 aa, Populus trichocarpa
MGKKEQQLQPQKDHKDNDRGEAVLELLRKHAPLTVKQEKFCNNACVERFLRAKGDNVKKAAKHLRACLSWRESIGTENLIADEFSAELAEGVAYVAGHDEESRPVMIFRIKQDYQKFHSQKLFTRLLVFTLEVAIGTMPRNAEQFVLLFDASFFRSASAFMNLLLGTLKIVAEYYPGRLYKAFVIDPPSLFPYLWKGVRPFVELSTATMVVSSLDFEESLEFNDFSSYPRASSLRLDPSSVKSTAKIGSCSSSRFSFTVSHHFDSLKPWHLTLTDTSASKVGPTNLSSLGPALISPLNARSFSFASPVARTPRGSMNGGSYTRLAQKSLFPSTPLPQRVTTSDTLKISQPRTPRPSFLQSPALFFKKECHVSKADRSRESFVPFLKFYRRPYDEMIYRSKMRPPLGGLISIVSPHIKRRHMSVSQRF

SEQ ID NO: 170 - DNA, 1314 bp, Zea mays
atggccatcgacaaggtggacgccaaggagagggagaagatcgaggccgtacgcaagctgctgtgcaagcaggcgccgctctccgcgaagcaggcgcagtactgcaacgacgcgtgcttggagcggttcctgcggtcgcggggggacagcgtcaagaaggcggcgaagcacctgaggaccgtcctctcatggagggagagcgtcggagctgatcacatcatggccgacgagttctccgccgagctcgccgacggcgtggccttcgtctccggccacgacgacgacggccgcccagtcgtggtgtttcgaatcaagcaggactaccccaagttccactctcagaaatcgttcgtgcgcctgctggtgttcacgctggaggtggccgtggcgtgcatgtcccggttcgtggaccagttcgtcgtcctcttcgacgcaagctttttccgctcggcgtcggctttcctcaacctactcatgggcacgctcaagatcgtcgccgactactaccccggccgcctccaccgcgccttcgtcatcgacccgccctccctcttctccgtcctctggaagggggtgcggccgttcgtggagctggcgccagcgacggcggtggtgtgctccctggacttcgaggactcgctcgaggacgcgtctttcacggcgtacccgcggaccgcgtcgctgcggttcgagccggcggccgtcgtggggaagaacccgggcgtggggtcggtctcgtcgcggttctccgtcacccccaccgacaaccccatcaagccgtggtacctctccaccatccccacctcggtgggctcccgctccgtggtgcccacctccagcagcccgtcgctggtcggcgcgtccccgctctccgcgcgctccttctccttcgcctcgcccgccacgctgcgctccacggtcgccacgccgccgccgttcccgcgcggcgcgggcgcgcccctgacgccgtcctccgccgccaaggcccagaagaccccgccgcagccgcagcagttcccgcggacgccgcgcccgtcgttcctgcagtcgccgtcgatgctgttcgcgttccggaaggacgggcaggccagccgcgtggagcgcgagcgcgagtccttcctcccgtacctgcgcttctaccgccggccctacgacgagatttcctaccgcgccaagatgcgccccccgctcggcggcctcatatccatcgtcggcgacaagttcaggcagaagccggtgccgcagccgcagccgctgcgtcgccacgctgggctccaccaccagcaccattaccagcagcagcagaggatctga

SEQ ID NO: 171 - protein, 437 aa, Zea mays
MAIDKVDAKEREKIEAVRKLLCKQAPLSAKQAQYCNDACLERFLRSRGDSVKKAAKHLRTVLSWRESVGADHIMADEFSAELADGVAFVSGHDDDGRPVVVFRIKQDYPKFHSQKSFVRLLVFTLEVAVACMSRFVDQFVVLFDASFFRSASAFLNLLMGTLKIVADYYPGRLHRAFVIDPPSLFSVLWKGVRPFVELAPATAVVCSLDFEDSLEDASFTAYPRTASLRFEPAAVVGKNPGVGSVSSRFSVTPTDNPIKPWYLSTIPTSVGSRSVVPTSSSPSLVGASPLSARSFSFASPATLRSTVATPPPFPRGAGAPLTPSSAAKAQKTPPQPQQFPRTPRPSFLQSPSMLFAFRKDGQASRVERERESFLPYLRFYRRPYDEISYRAKMRPPLGGLISIVGDKFRQKPVPQPQPLRRHAGLHHQHHYQQQQRI

SEQ ID NO: 172 - DNA, 1496 bp, Arabidopsis thaliana
gcttttgactcacttttttaatctttttggattttggtgaaaaagtttaatttgtctctttctctatttatctccggcgtcaatttcacggcggctacacgacggttatcgatgtcattgactgtaccggagttcgatttcagattgacgccacagtttggtttctcacagtcaccgatcggggagcgtaatttcgcggatgttgataatctggagaactgtattaagtatttgaatcagagcttagtcacctctggattctctgcttcgcttgacctcttcgctaccgatcctgtttcgattgctagaacttgcaattgcgtatacgctttgattcaacagaggcaacgagatgtggaatttagagaatctgctaatgatcagagacaacgacttttatccgatatggcgagactcgaagcaaaagttgaaaggcttgagactcaattgcaagctaaagaaagggaacttggttcggtgacaagaacggaagcaaaaaatacagcggctttaaagacgcagaatgagaagcttcaaaaagagagagatgagtttcaacgaatggtgattgctaaccagcaagtcaagacccaacaattacatgaaacaaaaaagaaagaaaaagagtacataaagttacaggagaggttaaaccaagtgttgatggagaaaaagaaggaaacgagatcaggcatggagattatgaatctactccagaaagaagggagacagcgtggaacatggagtgggaagaaaactgactctgatttctacaaaaaaattgtggatgcatatgaggcgaaaaatcaagaactgatggcagagaacactgatctgagagcgttactacgatcaacgcagggtgacatgcgttctttcttgaatgcttctggtggattaaccaaccaatctttggtagctaatggaagacacggtgcagacccttctcagtctcctttgggcgggaagacggacgtttttgacctaccttttcgtatggcacgaggtcaaatagaagatagtttacgctctaagatggtttccatcaaggaacgtatgggtcagttagtagatgcacaaaaagaagtatccattacttcagaagcgtcagagagggaacttgaacttgaagcacaactcgtcgaggcacgcagcattattcaagaacaggaatctataatgtccaaacatttacctaagacagatcggagaaggaactcagctcctccacattcttctgtcaacggactgcgtggctgactaattagattgtgaatctcaggttcaaaatatcaaatctcttcctgtaatttgatcttgctaaacaaagaaatgttttatgaacttataaaaaaatttaaatgaatgtggattcgtatttgtaacgttgtacagaacacttgcagacagcaagctgcaagctgtagagtattatagatggagagatatgttttatatcataatatagatgcctttctttataaaagaaatcgaat

SEQ ID NO: 173 - protein, 284 aa, Arabidopsis thaliana
MARLEAKVERLETQLQAKERELGSVTRTEAKNTAALKTQNEKLQKERDEFQRMVIANQQVKTQQLHETKKKEKEYIKLQERLNQVLMEKKKETRSGMEIMNLLQKEGRQRGTWSGKKTDSDFYKKIVDAYEAKNQELMAENTDLRALLRSTQGDMRSFLNASGGLTNQSLVANGRHGADPSQSPLGGKTDVFDLPFRMARGQIEDSLRSKMVSIKERMGQLVDAQKEVSITSEASERELELEAQLVEARSIIQEQESIMSKHLPKTDRRRNSAPPHSSVNGLRG

SEQ ID NO: 174 - DNA, 1170 bp, Zea mays
atgtcctcgtcggcgcgtttcgatctccgggcctcgtcgcatcagttgcagccgccgccgtcgcacgccagcatgagcagcgacgggggcgcgttcgcaaacgcggagaacctggagcactgcgcccggtacctgaaccagacgctcgtcaccttcggattcccggcatctctcgacctcttcgccaccgatccggtctcgattgcaagaacttgtaactgcatctatgcgctgctgcagcagcgacagagggacattgagttcagggagtctacaaatgaccagcggcagcggatgcaatctgatatctcacggctggaagctaagatagagagaatggatgctcaattagcagcgaaagatcgagagctagccactcttactcgaacggaggccaaaaacactgctgctctgaagtctcagattgataagctgcaacaagaacgtgatgaatttcagaaaatggttataggaaatcagcaagtacgcacccagcaaattcatgaaatgaagaagaaagagaaagaatacataaagttgcaggaaaagctaaatcaggtattgatggagaagaaaaaggaatcatcccgttctggaatggagataatgaacttgttgcagaaagaaggacgacaacgcggaacatggaatggaaaaaagaacgacaatgattattacaaaatgattgttgatgcatatgaagtaaagaaacaagagctgatgcaagagaatgcagatttacgggcactgttacgttcaatgcagatggacatgcgtgactttctcaatgccccgaatgggtcatcacaatctactgttactgataatggaagacaggagtcagggtctcctcagtctccgcttggtggcaagacggatgtttttgacttgccctttcatatggccagagatcagatagaagagagtttgcgcacaaaaatgacttcaatcaaggcacgaatgacacaacttcaagatgctcagaaaggtgcagaagtgacttctgaggcaactgaccgggagcttgagcttgaagctcaactggttgaagcaagaagcatcatccaagagcaggcctgcatcatgtccaagcacttcaagtctgataagccaagtggcaggaggcatagcggtctggatggcgagcgtgaggcatctgccgaggtgtaa

SEQ ID NO: 175 - protein, 389 aa, Zea mays
MSSSARFDLRASSHQLQPPPSHASMSSDGGAFANAENLEHCARYLNQTLVTFGFPASLDLFATDPVSIARTCNCIYALLQQRQRDIEFRESTNDQRQRMQSDISRLEAKIERMDAQLAAKDRELATLTRTEAKNTAALKSQIDKLQQERDEFQKMVIGNQQVRTQQIHEMKKKEKEYIKLQEKLNQVLMEKKKESSRSGMEIMNLLQKEGRQRGTWNGKKNDNDYYKMIVDAYEVKKQELMQENADLRALLRSMQMDMRDFLNAPNGSSQSTVTDNGRQESGSPQSPLGGKTDVFDLPFHMARDQIEESLRTKMTSIKARMTQLQDAQKGAEVTSEATDRELELEAQLVEARSIIQEQACIMSKHFKSDKPSGRRHSGLDGEREASAEV

SEQ ID NO: 176 - DNA, 1116 bp, Brassica napus
atgccgccgactgatgctgagttcgatcccaaagtgttgcctcagtccgcgacgggcgactacacattcgcgaacgtggacaatctggagcattgtgcaaagtacttgaaccagacgatggttacatttggattcccggcctcgctcgatctcttctccaacgatccggtttctatctcgaggacctgtaattgcatgtactcgttgcttcagcagcgacagcgcgacttggagttcagagaatctgctaatgagctgaggcagagacaacaatcggatatagctagacttgaagctaaagttgagaggctcgatgcgcagctccaacacaaggacagggaaatcgcaacgattactagaacagaagcgaaaaacacagcggctttgaagtcgcagattgaaaagctacagcaggagagagatgagttccaaagaatggtgatcggtaaccagcaagtcaaagctcaacagatccatgaaatgaagaaaaaggaaaaggattacattaaattacaggaacggttgaatcaagtattgatggagaaaaagaaagaatcgaaatcaggaatggagatcatgaatttgctacagaaagaagggaggcagcgtgggacctggaatggcaagaagactgatactgacttctacaaaaagatagtggatgcatatgaagcaaaaaaccaagagttaatggctgagaacacaaacctaagagcactgcttcgatccatgcagacagatatgcgtgatttcttaaacgctccaaacgggtcagctaatccttcattggctggcaacgagaaacgtgaggccgatccttcacaatctccactgggtggaaagacggatgtctttgatctacctttccgtatggctagaggtcaaatagaagaaagtttgcgcactaagatggcttccataaaggaacgcatggttcagttacaagatgcacctaaaggagcatctgtcacttctgaagcaacagagagagagcttgaacttgaagctcagctagccgaggcaagaagcataatccaagaacaggagtccataatgtgtaaacacctcccaaaatcagagcagcgaaagggaatccatggttccattgacagctga

SEQ ID NO: 177 - protein, 371 aa, Brassica napus
MPPTDAEFDPKVLPQSATGDYTFANVDNLEHCAKYLNQTMVTFGFPASLDLFSNDPVSISRTCNCMYSLLQQRQRDLEFRESANELRQRQQSDIARLEAKVERLDAQLQHKDREIATITRTEAKNTAALKSQIEKLQQERDEFQRMVIGNQQVKAQQIHEMKKKEKDYIKLQERLNQVLMEKKKESKSGMEIMNLLQKEGRQRGTWNGKKTDTDFYKKIVDAYEAKNQELMAENTNLRALLRSMQTDMRDFLNAPNGSANPSLAGNEKREADPSQSPLGGKTDVFDLPFRMARGQIEESLRTKMASIKERMVQLQDAPKGASVTSEATERELELEAQLAEARSIIQEQESIMCKHLPKSEQRKGIHGSIDS

SEQ ID NO: 178 - DNA, 1137 bp, Glycine max
atgcctcccactgacggagacttggatcttaggccaccttctcaatcttccttcacagccggcgactacacgttcgccgatgcggacaatttggagcattgcgctaagtatctcaaccaatcgctcgtcacgtttggtttcccggcttcgctcgatctcttcgcaaatgaccccgtttcaattgcgaggacttgcaattgcatttacgtcttgctgcagcagagacagcgcgacgtggagtttagagagtctgctaatgatcaaagacaacgactgttgtctgacatttcgagattggaggccaaagtggagaggcttgaaggtcaactacaagtcaaagacagggagatagcgactattactagaacggaagctaaaaacactgcagctctgaaggcccaaattgagaagctgcaacaggagagggatgaattccagagaatggttattggtaatcagcaagtaaagactcaacaaatgcatgagatgaagaagaaggaaaaagaatacataaagttgcaggagaggctaaaccaagtgttgatggagaagaagaaagagtctaggtcaggcatggagataatgaatttgcttcagaaggaagggaggcaacgtggaacatggaatgggaagaaagctgacaatgatttttataaaaagattgtggatgcttatgagtcaaaaaatcaagaactgatggcagagaatgctgatttaagagcattattgagatcaatgcaggtggatatgcgtgatttcttaaatgctcctaatggactaccaaagcaatctttcactggcaatgaaagagttgaaagtgatccttcacaatctccattggttgggaaaatggatgtatttgaccttccttttcacatggccagagatcaaatagaagaaagtcttcgcaacaaaatggcttctataaaggagcgtatggttcaattgcaagatgctcaaaaagaagcagaagttacttcagaggctactgagagggaacttgagcttgaagctcaacttgtcgaagcaaggagcatcatacaggagcaggcatcaataatgtctaaacatcttgcaaaatctgacaggccaagggaatctatcatcccagcaccggctgaggcagtatgcaattaa

SEQ ID NO: 179 - protein, 378 aa, Glycine max
MPPTDGDLDLRPPSQSSFTAGDYTFADADNLEHCAKYLNQSLVTFGFPASLDLFANDPVSIARTCNCIYVLLQQRQRDVEFRESANDQRQRLLSDISRLEAKVERLEGQLQVKDREIATITRTEAKNTAALKAQIEKLQQERDEFQRMVIGNQQVKTQQMHEMKKKEKEYIKLQERLNQVLMEKKKESRSGMEIMNLLQKEGRQRGTWNGKKADNDFYKKIVDAYESKNQELMAENADLRALLRSMQVDMRDFLNAPNGLPKQSFTGNERVESDPSQSPLVGKMDVFDLPFHMARDQIEESLRNKMASIKERMVQLQDAQKEAEVTSEATERELELEAQLVEARSIIQEQASIMSKHLAKSDRPRESIIPAPAEAVCN

SEQ ID NO: 180 - DNA, 1218 bp, Medicago truncatula
atgccttccactgaaggagacttagatcttaggccatcttctcattctgctttcacaaccggagaatacacattcgccgatgtaaacaatttggaacattgtgctaagtatctgaaccaatcactcgttacatttggttttcccgcttcactcgatctattctcaaacgatcccgtttctatagcgaggacgtgcaattgcatatacttcttgcttcagcagagacagcgtgatgtcgaatttagagagtctgccaatgaacaaagacaacgattgttgtcggatatatcgagatatgaggctaaagttgagagacttgatggacaattacaagctaaagatagagagatagcgacgataactagaacggaagctaaaaatactgcagctctcaaggctcaaattgagaagctgcaaaaagagagggatgaatttcagaggatggttattggcaatcagcaagttaggactcaacaaatacatgagatgaagaagaaggaaaaggaatacattaagttgcaggagagactaaaccaagtgttgatggagaagaagaaagaatctaggtcgggcatggagataatgaatttgcttcagaaggaagggaggcaacgtggaacatggaatgggaagaaaactgacaatgatttttataaaaagattgtggacgcttatgaggtgaaaaatcaagaactgatagcagaaaatgctgatttaagggcattattgagatcaatgcaggttgatatgcgtgatttcttaaatgctcctaatggactaccaaatcaatctcccactactaacgaaagatctgaaagtaatccttcacattctccgctggttggaagaacggacgtatttgatcttccttttcacatggcaagagatcaaattgaagagagtctaagagcgaagatggcttctataaaggagcgcatggtccaactgcaagatgctcagaaagaggccgaagtcacttcggaagctaccgagagagaacttgagcttgaagctcaacttgttgaagcaaggagcattatacaagagcaggcttctataatgtctaaacatcttgcaaagtctgacaggccaagtaaattgatttactctttgaattttacagggaatcggctccggctgaggggtagtgctagactgggagcacatgttggtgtagaaacggtgttgatgatggcatttagcatcaaccttttgtga

SEQ ID NO: 181 - protein, 405 aa, Medicago truncatula
MPSTEGDLDLRPSSHSAFTTGEYTFADVNNLEHCAKYLNQSLVTFGFPASLDLFSNDPVSIARTCNCIYFLLQQRQRDVEFRESANEQRQRLLSDISRYEAKVERLDGQLQAKDREIATITRTEAKNTAALKAQIEKLQKERDEFQRMVIGNQQVRTQQIHEMKKKEKEYIKLQERLNQVLMEKKKESRSGMEIMNLLQKEGRQRGTWNGKKTDNDFYKKIVDAYEVKNQELIAENADLRALLRSMQVDMRDFLNAPNGLPNQSPTTNERSESNPSHSPLVGRTDVFDLPFHMARDQIEESLRAKMASIKERMVQLQDAQKEAEVTSEATERELELEAQLVEARSIIQEQASIMSKHLAKSDRPSKLIYSLNFTGNRLRLRGSARLGAHVGVETVLMMAFSINLL

SEQ ID NO: 182 - DNA, 1197 bp, Oryza sativa
atgtccgcctcctcgcgcttcgatctccgggcctcgtcgcacccgcaccagcacgccatcggaggcggaggcggaggcggaggcatgagtgacggtggcggtggcgcggcggcggcgttcgcggacgcggggaacctcgagcactgcgccaggtacctcaaccagacgctcgtcaccttcggcttcccggcctcgctcgatctcttcgccaccgaccccgtatcgattgcgagaacgtgcaactgcatctatgctcttcttcagcagcggcagcgtgatattgagttccgggagtctaccaatgatctgcgtcagcgtatgcagtctgatatttctagattagaagccaagattgaaagaatggatgctcaattagctgcaaaagatcgcgagctggccacattgactagaacggaggccaaaaacactgcaactttgaaggctcagattgacaagctgcaacaggaacgcgatgagttccaaaaaatggttattggcaatcagcaagtacgtacccagcaaattcatgaaatgaagaaaaaagagaaagaatacatcaaattgcaggagaagttaaaccaggtattaatggagaaaaagaaggaatcatcacgttcaggaatggaaataatgaacttgttgcagaaagaaggacggcagcgtggaacttggagtggaaaaaagaatgacaatgattattacaaaatgattgttgatgcctatgaggtaaagaagcaagagttgatgcaagaaaatgctgatttgcgagcactattgcgttcgatgcagatggatatgcgcgagttcctcaatgctccaaatggagttccacagccagctgttgtgggcaatggacgacaggaggcaggatctcctcagtctccacttggtggcaagacggatgtctttgatttgccctttcacatggctagagaccagattgaagagagtttgcgcactaaaatggcttccataaaggcccgaatgacacaacttcaagatgcccaaaagggtgcagaagtgacatcagaagctaccgagcgggaacttgaacttgaagctcaactagttgaagctagaagcattatccaggagcaggcatccctcatgtccaagcactttacgaagtctgataaaccaaggaggttgagtggattggatgctgagcgtgaggcggttgcagctcaggaggtgtaa

SEQ ID NO: 183 - protein, 398 aa, Oryza sativa
MSASSRFDLRASSHPHQHAIGGGGGGGGMSDGGGGAAAAFADAGNLEHCARYLNQTLVTFGFPASLDLFATDPVSIARTCNCIYALLQQRQRDIEFRESTNDLRQRMQSDISRLEAKIERMDAQLAAKDRELATLTRTEAKNTATLKAQIDKLQQERDEFQKMVIGNQQVRTQQIHEMKKKEKEYIKLQEKLNQVLMEKKKESSRSGMEIMNLLQKEGRQRGTWSGKKNDNDYYKMIVDAYEVKKQELMQENADLRALLRSMQMDMREFLNAPNGVPQPAVVGNGRQEAGSPQSPLGGKTDVFDLPFHMARDQIEESLRTKMASIKARMTQLQDAQKGAEVTSEATERELELEAQLVEARSIIQEQASLMSKHFTKSDKPRRLSGLDAEREAVAAQEV

SEQ ID NO: 184 - DNA, 1266 bp, Physcomitrella patens
atggggttaaccgacgttgatggtggttacgggggtttatatgattctagcgacgtgtttggggatgatacttttgcagacattcacaatttggaccactgcattaagtatctcaaccagtctttagttacatttggctttccatcaggactagatctttactccagtgaaccatcttcaatcgtgcgaacatgcaactgcatatatgccatgattcagcagcgacagcgggacatcgaatatcgtgaagcagccaatgactcgaggcaaaggctaatgtcagatatgtcccggcttgaagctaaggtggaaaggcttactgatcagctggcaagtaaagaacgtgaattgcaagcaatcacaagcaaggagcaaaaagcggcagctactagcagagctcaaattgagaagctccagcatgagaaagatgagtttcaaaggatggtgattagtacacagcaagttaaagctcagcagatgcatgaactgaagaagaaagagaaagagtatatcaagttgcaggaacggttgaatcaagtattaatcgaaaagaagaaagattctaagaatggtattgagatcatgaatttattacagcagaaagagggcaggcaacgggggacttggaacaccaagaaagcagatggtgatttctataagatgatagtggatgcttatgaaacaaagaagcaagatcttgtggctgaaaatttggaattgcggggtttgcttcgatctatgcaggatgacatgcgtgattttttgaacaccccgagtgggctgattagacctggcactggagtaagctctcacgaacatgaaccacctgccacacccctgggaggccgaacggatgtattcgacctaccttttcatatggcgagagatcagattggagaaagcttacgtgctaaaatgtctaccattaaagaacgaatgatgcagctgcaagaaagtcaaaagttacttgatgcaggaagagaaactagtgagcgcgagcaagctcttgaggcgcagcttctagaggcccgcagcattatttctgaacaggctagtctaatgaacaaacacatgtcggaggaggatgacagcagtcacgtcattgcaaagttaatggagtcggaaaataaagcaagtactgcacagggcataaatttgtattttcaatcgatggtccgaatcatactgggatgttgcgaacaggaagaggagcgaatatcaaagataaagacatttgacgggacaattttatccaaggtattctaa

SEQ ID NO: 185 - protein, 421 aa, Physcomitrella patens
MGLTDVDGGYGGLYDSSDVFGDDTFADIHNLDHCIKYLNQSLVTFGFPSGLDLYSSEPSSIVRTCNCIYAMIQQRQRDIEYREAANDSRQRLMSDMSRLEAKVERLTDQLASKERELQAITSKEQKAAATSRAQIEKLQHEKDEFQRMVISTQQVKAQQMHELKKKEKEYIKLQERLNQVLIEKKKDSKNGIEIMNLLQQKEGRQRGTWNTKKADGDFYKMIVDAYETKKQDLVAENLELRGLLRSMQDDMRDFLNTPSGLIRPGTGVSSHEHEPPATPLGGRTDVFDLPFHMARDQIGESLRAKMSTIKERMMQLQESQKLLDAGRETSEREQALEAQLLEARSIISEQASLMNKHMSEEDDSSHVIAKLMESENKASTAQGINLYFQSMVRIILGCCEQEEERISKIKTFDGTILSKVF

SEQ ID NO: 186 - DNA, 1146 bp, Populus trichocarpa
atgccaacttctgatactgacttcgatctcagctcctctcccgcatctgccttctcaatcggagagtatacatttgctgatgtgaataacttggagcattgtgcaaagtacttgaaccagactcttgttacctttggtttccctgcctctcttgatcttttcgctaatgatccggtttcaaccgcccgaacctgcaactgcatttactctttgcttcaacagaggcagcgcgacgttgaatttagagaatctgccagtgagcagagacagagactactatcagatatatcgagattggaagctaaggttgagaggcttgagtcgcagttacaagccaaagatagagagatagcgacaataactagaacggaagccaaagctacagcagcttttaaggcccaaattgaaaagcttcaacaagaacgtgatgaatttcaaaggatggtaattggtaatcagcaagtgaggactcaacaaatacatgaaatgaagaaaaaagaaaaggagtacataaagttgcaggagaggctaaaccaagtgttaatggagaaaaagaaggaatcacgatcaggcatggagataatgaatttgcttcagaaagaagggcggcagcgtgggacatggaacggaaagaaggctgataatgatttctacaagaaaattgtggatgcttgtgaggctaaaaatcaagagttaatggcagagaataatgatttaagggcattgctgcggtcaatgcaggttgatatgcgtgacttcttcaatgcaccaaatgggtcatccaaacaatctccacctgccaatgagagacttgtaacagacccctcacaatctcccttgggtgggaggacggatgtgtttgacttgccttttcacatggctagagatcaaattgaagaaagtctccgaaccaagatgtcttccataaaggagcgtatggttcaactacaagatgcacagaaaggagcagaagtcacctctgaagcgactgagagagaactagagctcgaagctcaacttgttgaggcaagaagcataatccaggagcaggcatctataatgtctaagcatcttgcgaagtcagagaggccaagggaatctatcatctcttcaccagctgaggtagtacgagaccaacggggttga

SEQ ID NO: 187 - protein, 381 aa, Populus trichocarpa
MPTSDTDFDLSSSPASAFSIGEYTFADVNNLEHCAKYLNQTLVTFGFPASLDLFANDPVSTARTCNCIYSLLQQRQRDVEFRESASEQRQRLLSDISRLEAKVERLESQLQAKDREIATITRTEAKATAAFKAQIEKLQQERDEFQRMVIGNQQVRTQQIHEMKKKEKEYIKLQERLNQVLMEKKKESRSGMEIMNLLQKEGRQRGTWNGKKADNDFYKKIVDACEAKNQELMAENNDLRALLRSMQVDMRDFFNAPNGSSKQSPPANERLVTDPSQSPLGGRTDVFDLPFHMARDQIEESLRTKMSSIKERMVQLQDAQKGAEVTSEATERELELEAQLVEARSIIQEQASIMSKHLAKSERPRESIISSPAEVVRDQRG

SEQ ID NO: 188 - DNA, 1170 bp, Zea mays
atgtcctcgtcggcgcgtttcgatctccgggcctcgtcgcatcagttgcagccgccgccgtcgcacgccagcatgagcagcgacgggggcgcgttcgcaaacgcggagaacctggagcactgcgcccggtacctgaaccagacgctcgtcaccttcggattcccggcatctctcgacctcttcgccaccgatccggtctcgattgcaagaacttgtaactgcatctatgcgctgctgcagcagcgacagagggacattgagttcagggagtctacaaatgaccagcggcagcggatgcaatctgatatctcacggctggaagctaagatagagagaatggatgctcaattagcagcgaaagatcgagagctagccactcttactcgaacggaggccaaaaacactgctgctctgaagtctcagattgataagctgcaacaagaacgtgatgaatttcagaaaatggttataggaaatcagcaagtacgcacccagcaaattcatgaaatgaagaagaaagagaaagaatacataaagttgcaggaaaagctaaatcaggtattgatggagaagaaaaaggaatcatcccgttctggaatggagataatgaacttgttacagaaagaaggacgacaacgcggaacatggaatggaaaaaagaacgacaatgattattacaaaatgattgttgatgcatatgaagtgaagaaacaagagctgatgcaagagaatgcagatttacgggcactgttacgttcaatgcagatggacatgcgtgactttctcaatgccccgaatgggtcatcacaatctactgttactgataatggaagacaggagtcagggtctcctcagtctccgcttggtggcaagacggatgtttttgacttgccctttcatatggccagagatcagatagaagagagtttgcgcacaaaaatgacttcaatcaaggcacgaatgacacaacttcaagatgctcagaaaggtgcagaagtgacttctgaggcaactgaccgggagcttgagcttgaagctcaactggttgaagcaagaagcatcatccaagagcaggcctgcatcatgtccaagcacttcaagtctgataagccaagtggcaggaggcatagcggtctggatggcgagcgtgaggcatctgccgaggtgtaa

SEQ ID NO: 189 - protein, 389 aa, Zea mays; identical to SEQ ID NO: 175

SEQ ID NO: 190 - DNA, 1083 bp, Brassica napus
atggaagcccttgttgttgatgctggttcgaagctcctgaaagcaggagcagcgattcctgaccagtctcctgcaatgataatcccatctcagatgaaacgaatggttgatgatgcgtctgataaccccaccactgtttttgaagacgtcactcttgatcctatcgaaagagggttcattagagactgggacgctatggaggatctgttgcgttacgttgtgtacactgggcttggatgggaagagggaaacgaaggcaacatactcttcacagatccactctgcactcctaaggctattagggagcagttagtgcagttgatgtttgaaacgttcaacgtgtctggattctatgcgtcagagcaagcagtgttgtctctttatgctgttggaagaatctccggttgcactgttgatattggtcatgggaagatagatattgccccagttcttgaaggtgctgtgcagcacattgcctcaaaacggtttgagctcggtggaacggatcttacaaaactattcgcccaagagcttggaaaatccaacccttctgtgaatctcagcatgtctgatgttgaaacattgaaggaacagtatgcaaactgtgctgaggacgaggttgcgtacgagaaaacccaaaactgtgaaatcgagcagcatacacttcctgatggacaggtgataaacattgggagagagagatactctgttggtgaagctttgtttcagccatcaatacttggactggaggagcacggaatagttgaacagcttgtccggattatctcaacagtatcatctgagaaccataggcaactcttggagaacactgtactttgtggtggtacaacctccatgacaggattcgaaggaaggtttcagaaagaagcaagcttgtgctcatctgccattaggccaacgctggtgaaacctcctgaatatatgagtgagaatttgggattgtactcggcttggataggaggagcaatactagccaaggtggtgtttccgcagaatcagcatgttactaaagctgactacgacgagactggaccatctgtggttcacaggaaatgtttctga

SEQ ID NO: 191 - protein, 360 aa, Brassica napus
MEALVVDAGSKLLKAGAAIPDQSPAMIIPSQMKRMVDDASDNPTTVFEDVTLDPIERGFIRDWDAMEDLLRYVVYTGLGWEEGNEGNILFTDPLCTPKAIREQLVQLMFETFNVSGFYASEQAVLSLYAVGRISGCTVDIGHGKIDIAPVLEGAVQHIASKRFELGGTDLTKLFAQELGKSNPSVNLSMSDVETLKEQYANCAEDEVAYEKTQNCEIEQHTLPDGQVINIGRERYSVGEALFQPSILGLEEHGIVEQLVRIISTVSSENHRQLLENTVLCGGTTSMTGFEGRFQKEASLCSSAIRPTLVKPPEYMSENLGLYSAWIGGAILAKVVFPQNQHVTKADYDETGPSVVHRKCF

SEQ ID NO: 192 - DNA, 858 bp, Gossypium hirsutum
atggaggcggcagtggtcgatgctggctccaagctcctcaaggcgggacttgctgtcccagatcaggctccatccttgataatacctactcaaatgaaacgtatgctggaagatggatcatctgttgataattcattgttagaagatgttaccattgatcctgttgtgcgaggatgcgttaaagactgggatgccatggaagatttgttgcaccatgttctatacacgggccttgaatgggaagttggaaatgaaggacaaattttgtttactgaaccgctttgtactcccaaggctgttagagaacgactggtgcaattgctatttgaaacttttaatgtatcgggattttatgcgtcggaacaagcagtattatctctgtatgctgtcgggcgtatctcaggttgtactgttgatattggtcatgggaagatagacatagctgcagtacttgaaggtgctgtccaacacattgcctcaagaagatttgaagttggaggtattgatttgacaaagctacttgctcaagagctgggtaaatcaaatcctatggtgaacctcagcttatctgatgttgagaaactaaaagagcaattctcgtgttgtgctgaagatgaagttgcttatgacagaatgctcagatcatgtgaaacagaggaacatactcttcctgatggacaggtgataagaattggaagggaaagatttactgttggtgaggcattgttccaccatctatattgggctagaagctcatggaattgtgagcagcttgttcgtaatattgcaacggtttcttctgagaaccaaaagcaacggttaaaaataccgttctttggggtgggactacctctatga

SEQ ID NO: 193 - protein, 285 aa, Gossypium hirsutum
MEAAVVDAGSKLLKAGLAVPDQAPSLIIPTQMKRMLEDGSSVDNSLLEDVTIDPVVRGCVKDWDAMEDLLHHVLYTGLEWEVGNEGQILFTEPLCTPKAVRERLVQLLFETFNVSGFYASEQAVLSLYAVGRISGCTVDIGHGKIDIAAVLEGAVQHIASRRFEVGGIDLTKLLAQELGKSNPMVNLSLSDVEKLKEQFSCCAEDEVAYDRMLRSCETEEHTLPDGQVIRIGRERFTVGEALFHHLYWARSSWNCEQLVRNIATVSSENQKQRLKIPFFGVGLPL

SEQ ID NO: 194 - DNA, 1086 bp, Glycine max
atggaagcggcagtggtggacgtcggctctaagctcctcaaagcgggctttgcaattcctgaccagactcctgccatgataattcccactcagatgaagcaattactcgatgatggatccgtcgcagataattcactggctgacaatgtcaccgttgatcccgttgtgcgaggatttattagagattgggatgcaattgaggatttgttgcaccatgttttgtataccggcctcggatgggaaattggcaatgaaggacaaatactatttacagatccactttgtaccccaaaggcgaacaaagaacagttggtgcaactaatgtttgaaacattcaatatatcaggattttatgcctcagaacaagcagtgttatcactctatgctgtgggacgtatctcaggctgcactgttgatattggacatggaaaaatagatattgcaccggtaattgagggtgctgttcaccacatcgcctcgagaagatttgagtttggaggtactgatctaactaatttcctggctcaagaacttggcaagtccaatccacaagtaaatatcagcatgtctgatgtggaaaaaataaaagagttgtactcatgctgtgctgaagatgaattagcttatcagaagaccgaatattcttgtcctgtggagaagcacacccttcctgatggacaggtgatagcaattgggagagaaagatatactgttggggaagctttattccagccatgtctactgggtttagaggctcatggcattgttgatcagcttgtccgtgctatttcaactgtgtcatctgataatcaacgacagctgctggaaaatactgtggtttgtggtggcacttcttctatgacaggttttgaagagagatttcagaaggaatctagcttaagttcatctgctgttcaacctaccctcgttaagcctccagaatacatgccagaaaatttaaccatgtattctgcatgggtgggaggtgccatacttgccaaagtggttttccctcaaaatcagcatataaccaaggcagactatgatgaaaccggaccttccattgttcatcggaaatgcttctga

SEQ ID NO: 195 - protein, 361 aa, Glycine max
MEAAVVDVGSKLLKAGFAIPDQTPAMIIPTQMKQLLDDGSVADNSLADNVTVDPVVRGFIRDWDAIEDLLHHVLYTGLGWEIGNEGQILFTDPLCTPKANKEQLVQLMFETFNISGFYASEQAVLSLYAVGRISGCTVDIGHGKIDIAPVIEGAVHHIASRRFEFGGTDLTNFLAQELGKSNPQVNISMSDVEKIKELYSCCAEDELAYQKTEYSCPVEKHTLPDGQVIAIGRERYTVGEALFQPCLLGLEAHGIVDQLVRAISTVSSDNQRQLLENTVVCGGTSSMTGFEERFQKESSLSSSAVQPTLVKPPEYMPENLTMYSAWVGGAILAKVVFPQNQHITKADYDETGPSIVHRKCF

SEQ ID NO: 196 - DNA, 813 bp, Medicago truncatula
atggaagctgcagtaattgatgccggttccagtctcctcaaagccggatttgctattcccgatcaaactcctgccatgataattcctagtcagatgaaacgaatggttgatgaaacaaatgataatggtaatggtcagttggtggtggatgatgtcgcggttgagccagtggtaagaggttatgttagagattgggatgctatggaggatttgttgaattatgttttgtacagtggacttggatgggaaattggtaatgagggacaaatattgtttacagatccactttgtaccccaaaggctaacaaagaacagttagtgcaacttatgtttgaaacgttcaacatatcagggttttatgcctcggaacaggcagttttatcactctatgccgtgggtaggatctctggatgcacagttgacattggtcatggaaaaatagatattgctccagtaattgagggtgctgttaaccacattgcctcaagaagatttgagtttggaggtactgatctaactaatttcctggctcaagaacttggcaaatccaatccactagtgaatatcagcatatctgatgtcgagaaaataaaacagcaatactcatgttgtgctgaagatgacttagcttatcaaaagacagaagactcttgtcctgtggaaacacatacccttcctgatggacaggtgataacaattggaagagaaagatatacagttggtgaagctttattccagccaagtctattggggttagagactcatgggattgtagagcagcttgtccgtactatttcaacccgtgacatctga

SEQ ID NO: 197 - protein, 270 aa, Medicago truncatula
MEAAVIDAGSSLLKAGFAIPDQTPAMIIPSQMKRMVDETNDNGNGQLVVDDVAVEPVVRGYVRDWDAMEDLLNYVLYSGLGWEIGNEGQILFTDPLCTPKANKEQLVQLMFETFNISGFYASEQAVLSLYAVGRISGCTVDIGHGKIDIAPVIEGAVNHIASRRFEFGGTDLTNFLAQELGKSNPLVNISISDVEKIKQQYSCCAEDDLAYQKTEDSCPVETHTLPDGQVITIGRERYTVGEALFQPSLLGLETHGIVEQLVRTISTRDI

SEQ ID NO: 198 - DNA, 1083 bp, Oryza sativa
atggaggcggtggtcgtcgacgcggggtcgaagctgctcaaggccggcatcgccttgcccgaccagtccccatcgctggtgatgccgtcgaagatgaagttggaggtagaggacggtcagatgggcgacggcgcggtggtggaggaggtggtgcagccggtggtgcgtggcttcgtcaaggactgggacgccatggaggacctgctcaactacgtcctgtacagcaacattgggtgggagattggggatgagggccagatcctcttcacagagccgctcttcacacccaaggcacttcgggagcaactggcgcaacttatgttcgaaaaattcaatgtttcaggcttttatgactctgagcaggctgtattgtcactttatgcagttggacgcatttcgggctgtacagtggacattgggcatgggaaaatcgatattgctccagtttgtgaaggtgctgttcagcacatagcatcaaagagatttgatattggaggaactgacttgacaaacctatttgcggaagaactcaaaaaatctaactcatcggtaaacattgatatttctgatgttgagcggctgaaagagcagtatgcatgctgtgcagaagatcaaatggcctttgaagctataggaagctcatgccgaccagaaaggcacacacttccagatgggcaggttataacaattgaaaaagaacggtacattgttggtgaagctttatttcaaccccacattttgggcttagaagattatggaattgttcatcagctggttacaagcgtctcgaatgtcacaccagagtaccatcgtcagctgcttgaaaacactatgttatgtggtggcactgcatcaatgactggttttgaagacaggttccagagagaagcaaatctgtctgcttcagcaatctgcccatctcttgtaaagcctccagaatatatgcccgagaacctagctaggtactcggcctggctgggcggtgcaatattggccaaggtcgttttcccgcaaaaccagcacgtcaccaagggagactacgacgagactggtccatccatcgttcacaagaagtgcttctga

SEQ ID NO: 199 - protein, 360 aa, Oryza sativa
MEAVVVDAGSKLLKAGIALPDQSPSLVMPSKMKLEVEDGQMGDGAVVEEVVQPVVRGFVKDWDAMEDLLNYVLYSNIGWEIGDEGQILFTEPLFTPKALREQLAQLMFEKFNVSGFYDSEQAVLSLYAVGRISGCTVDIGHGKIDIAPVCEGAVQHIASKRFDIGGTDLTNLFAEELKKSNSSVNIDISDVERLKEQYACCAEDQMAFEAIGSSCRPERHTLPDGQVITIEKERYIVGEALFQPHILGLEDYGIVHQLVTSVSNVTPEYHRQLLENTMLCGGTASMTGFEDRFQREANLSASAICPSLVKPPEYMPENLARYSAWLGGAILAKVVFPQNQHVTKGDYDETGPSIVHKKCF

SEQ ID NO: 200 - DNA, 1089 bp, Physcomitrella patens
atggagccggctgtgctcgactcaggatcgatgtacctgaaggcgggctttgctatccccgaccaagacccgtctataatccttccgacatcaatgacgagggtggaggaggatggggtgcatggtaacgatggcgttattggggacattatacatccaattgagcgaggaataattaaagactgggatgcaatggaagacctgtggcgctatactttctacaccggccttggttgggaacctggcaacgaaggacagcttcttgttgccgaacctttgttgactcctaaggtctcacgcgagagaatggttcagacaatgttcgagactttcaacgttggtggtctttatgcagtggagcaggctgtgctctctctttatgctgtaggccgcattactggtgtcgttattgatgctgggcatggaaagatagatattgctcctgtatgggaaggggccatacagcacaatgctgtgaagcgttttgaaatttctggtcaggatcttaccgatttccttgcgaaagagcttgcacggtcacaacctgatgtgaagttagaccttgccactgtggagatgcttaaggaaaaatatgcggcggttgctgaagactcatcagcttatgtcgcgactgctgaagcctgtcctaagatacaacacacacttcctgatgggcaggttatttctgttggtagagaaagatacgatgtcggcgaagctctgttacggccttctatctttggaatagaagaagatggtctggctgaacagttgcttcgcagcgtatcaacgtgttccccttctgagaatcagcggcagcttattgaaaacatcgttttgtgtggaggcacctctatgataaggggtttggattcacgatttcagaaggaggccgttctagtggcgaatccttcagtgcgaccgtcattgattaagccgcccgagtacatgcctgacaatactttgatcaattctgcatggatgggtggagcaattctcgccaaagttgtctttcctcagaatcagcacatcaccaaagctgagtacgatgaagctggccctccaattgttcaccggaagtgcttttga

SEQ ID NO: 201 - protein, 362 aa, Physcomitrella patens
MEPAVLDSGSMYLKAGFAIPDQDPSIILPTSMTRVEEDGVHGNDGVIGDIIHPIERGIIKDWDAMEDLWRYTFYTGLGWEPGNEGQLLVAEPLLTPKVSRERMVQTMFETFNVGGLYAVEQAVLSLYAVGRITGVVIDAGHGKIDIAPVWEGAIQHNAVKRFEISGQDLTDFLAKELARSQPDVKLDLATVEMLKEKYAAVAEDSSAYVATAEACPKIQHTLPDGQVISVGRERYDVGEALLRPSIFGIEEDGLAEQLLRSVSTCSPSENQRQLIENIVLCGGTSMIRGLDSRFQKEAVLVANPSVRPSLIKPPEYMPDNTLINSAWMGGAILAKVVFPQNQHITKAEYDEAGPPIVHRKCF

SEQ ID NO: 202 - DNA, 1092 bp, Populus trichocarpa
atggaggcggcggtgatagacgctggtactcagctccttaaagccggcaccgcagttccagatcaagctccgcccatgataattccgagccaaatgaaacgaatggtggaagatggaacatcgggtgataataatgaatccgtatttgaggatgtaactgtcgatcctgttgttcgaggttatataagagattgggatgcgatggaagatttgttgcattatgttttatacactagtcttggttgggaagagggaaatgaaggccaagttttgtttaccgatcccctttgcactcccaaggctgttagagaacaattggtacaattgatgtttgagacatttaatgtttctgggttttatgcgtcggagcaagcggtgttgtctctttatgcagttgggcgtatctctggatgcaccgttgatatcggtcatgggaagattgatattgcaccagtacttgaaggtgctgttcagcacattgcttcaagaagatttgaaattggtggtgttgatttgacgaagttacttgcccaagaactgggtaaatctaatcttttggtgaatctcaatgcatctgatgttgagatgttaaaagtaaagtactcctgttgtgctgaagacgagcttgcttacgagaagactcaaaggtcaagtgatacagaggagcatacccttcctgatggacaggtgattagaattagaagagaaaaatatacaattggtgaggcattatttcaaccatctatactgggtatagaggcacttggaatagttgagcagcttgtacgtagtatttcaactgtttcttcagagaaccaccgccaactgctggaaaatactgtactttgtggtggcataacttctatgcctggttttgaagataggtttcagaaagaagcaagcctgtgctcatcagctattcgtccttcacttgtaaagcctccagaatatatgcccgataagttgacagagtactctgcatgggtgggaggtgccatactagccaaagttgtgttccctcagaatcagcatgttaccaagggagattacgatgaaactggaccatccattgtccatcggaaatgcttttga

SEQ ID NO: 203 - protein, 363 aa, Populus trichocarpa
MEAAVIDAGTQLLKAGTAVPDQAPPMIIPSQMKRMVEDGTSGDNNESVFEDVTVDPVVRGYIRDWDAMEDLLHYVLYTSLGWEEGNEGQVLFTDPLCTPKAVREQLVQLMFETFNVSGFYASEQAVLSLYAVGRISGCTVDIGHGKIDIAPVLEGAVQHIASRRFEIGGVDLTKLLAQELGKSNLLVNLNASDVEMLKVKYSCCAEDELAYEKTQRSSDTEEHTLPDGQVIRIRREKYTIGEALFQPSILGIEALGIVEQLVRSISTVSSENHRQLLENTVLCGGITSMPGFEDRFQKEASLCSSAIRPSLVKPPEYMPDKLTEYSAWVGGAILAKVVFPQNQHVTKGDYDETGPSIVHRKCF

SEQ ID NO: 204 - DNA, 741 bp, Solanum lycopersicum
atggaggcagtagtagtggatgctggttctaaatttctcaaagctggtttcgctattccagatcaaactcctgctatggtaataccaacccaaatgaaacgcattgctgaagatgatgaaggttccttgtttgaggaggaggaagtggctgtggatcccattgagaggggtttcgttaaagattgggatgcaatggaagacctgttgcatcatgttctttattctggtcttggttgggaaattggaaatgaaggtcaaattttgttcactgacccgctctgcactcccaaggctattagggaacaattggtgcagttgatgtttgaaacattcaacatctcggggttttatgcctctgagcaggcagtactgtcgctttatgcagttggacgcatatctggctgtactgttgatgttggtcatgggaaaattgatattgcacctgtcattgagggtgctgttcagcacatagcatcaagaaggttggaagttgggggattggatttgacaaagctactagcagatgagcttagtaaatcaaatcccacagtgaaactcaatatttctgatgttgaaaaattgaaagagcagtatgcatgctgtgctgatgatgatattgcctatgagaagcttcaacactcttgcctgcaagagaaacatactctgcctgatggccacggtaatcacaattggaaaagaagatacactgttggagaggcattgtttcaccatctatattag

SEQ ID NO: 205 - protein, 246 aa, Solanum lycopersicum
MEAVVVDAGSKFLKAGFAIPDQTPAMVIPTQMKRIAEDDEGSLFEEEEVAVDPIERGFVKDWDAMEDLLHHVLYSGLGWEIGNEGQILFTDPLCTPKAIREQLVQLMFETFNISGFYASEQAVLSLYAVGRISGCTVDVGHGKIDIAPVIEGAVQHIASRRLEVGGLDLTKLLADELSKSNPTVKLNISDVEKLKEQYACCADDDIAYEKLQHSCLQEKHTLPDGHGNHNWKRRYTVGEALFHHLY

SEQ ID NO: 206 - DNA, 1089 bp, Triticum aestivum
atggaggcggtggtggtcgacgcggggtccaagctgctgaaggccggcatcgcgctgcccgaccaggcccccgggctggtgatgccctcgaagatgaagacggaggtggaggagagcgaggtggccgacggcgcggcggcggtggtggaggaggtggtgcatccggtggtgcgcggcttcgtcaaggactgggacgccatggaggacctgctcacctacgtcctctacaggaacatcggctgggagatgggggacgagggccagatcctcttcaccgagccgctcttcacgcccaaggctctccgggagcaattagtgcaacttatgttcgaaaaattcaatgtatcagggttttatgattctgaacaggctgtattgtccctttatgctgttggtcgcatttcgggttgtacggttgacattggacatgggaaaatagatattgctccagtttgtgaaggtgctgttcagcacgtagcgtcaaagagatttgagattggaggaactgacttgacaaacctatttgcgcaagaactaaagaagtccaacccatcagtaaacattgatatttctgacgttgagaggctgaaagagcagtatgcatgctgcacagaagatcagttagcctttgaagctatagcgagtacatgccagccagaaactcacactcttccagatggacaggttataacaattgaaaaagagcgctatatagttggtgaagctttgtttcaaccaagtatcttgggcttagaagattatggtattgtccaccagctaattactagtgtttcaaacgtcgcatcggagtaccaaaagcaagtgctcgagaacactatgctatgtggtggcactgtatctatgactggtttcgaggacaggtttcagagagaagcgaatctgtcggcttcggcgatccgcccgactcttgtgaaggccccggagtacatgccggaggacctggcgcggcactcggcgtggctgggcggcgcgatcctggccaaggtggtcttcccccagaaccagcacgtgaccaagggcgactacgacgagacgggcccgtccatcgtccacaagaagtgcttctga

SEQ ID NO: 207 - protein, 362 aa, Triticum aestivum
MEAVVVDAGSKLLKAGIALPDQAPGLVMPSKMKTEVEESEVADGAAAVVEEVVHPVVRGFVKDWDAMEDLLTYVLYRNIGWEMGDEGQILFTEPLFTPKALREQLVQLMFEKFNVSGFYDSEQAVLSLYAVGRISGCTVDIGHGKIDIAPVCEGAVQHVASKRFEIGGTDLTNLFAQELKKSNPSVNIDISDVERLKEQYACCTEDQLAFEAIASTCQPETHTLPDGQVITIEKERYIVGEALFQPSILGLEDYGIVHQLITSVSNVASEYQKQVLENTMLCGGTVSMTGFEDRFQREANLSASAIRPTLVKAPEYMPEDLARHSAWLGGAILAKVVFPQNQHVTKGDYDETGPSIVHKKCF

SEQ ID NO: 208 - DNA, 1083 bp, Zea mays
atggaggcggtggtcgtcgacgcgggctctaagctgctcaaggccggcatcgcggcgcccgaccaggcacccccactggtaatgccgtcgaagatgaagctggatgttgaggaccaggagatggctgacggcgcggtggtagaggaggtggtgcaccctgtggtgcgcggcttcgtcaaggactgggacgccatggaggacctactcaactacgtcctgtacagggacattgggtgggagattggggacgagggtcagattctcttcaccgaacccctcttcacgccaaagactcttcgggagcaattggtgcagcttatgtttgaaaagttcaatgtttcaggcttttatgcctctgaacaggctgtattgtcactctatgctgttggacgcatttcaggatgtaccgttgacattggtcacgggaaaatagatattgctccagtttgtgaaggagctgttcaacacatagcttctaagagattagagattgggggagttgacttgacaaacctgtttgcacaagaactgaaaaaatccaacccatcagtaaaccttgatgttgctgatgttgagctgctgaaagagcagtatgcgtgttgcacagaagattatttgacttttgaaagtatagaaagctcttgccaaccagaaaaacacactcttcctgatgggcaggttataacaattgaaaaagaggggtacattgttggtgaagctttatttcaaccacgtatattgggcttggaagattatggtatcgttcaccagctagtcactagtgtctcaaatgtttcatcagagtaccatcgtcagctgcttgaaaataccatgttatgtggtggcacctcatcaatgactggctttgaggacaggttccagagagaagcaaatctgtctgcttcagcaatctgtccatcacttgtgaagcctcctgaatacatgcccgagaacctagcaaggtactcggcctggttgggtggtgcgatattggctaaggtcgttttccctcaaaaccagcatgtgaccaagggcgagtatgatgagacggggccgtccattgtgcacaagaagtgcttttag

SEQ ID NO: 209 - protein, 360 aa, Zea mays
MEAVVVDAGSKLLKAGIAAPDQAPPLVMPSKMKLDVEDQEMADGAVVEEVVHPVVRGFVKDWDAMEDLLNYVLYRDIGWEIGDEGQILFTEPLFTPKTLREQLVQLMFEKFNVSGFYASEQAVLSLYAVGRISGCTVDIGHGKIDIAPVCEGAVQHIASKRLEIGGVDLTNLFAQELKKSNPSVNLDVADVELLKEQYACCTEDYLTFESIESSCQPEKHTLPDGQVITIEKEGYIVGEALFQPRILGLEDYGIVHQLVTSVSNVSSEYHRQLLENTMLCGGTSSMTGFEDRFQREANLSASAICPSLVKPPEYMPENLARYSAWLGGAILAKVVFPQNQHVTKGEYDETGPSIVHKKCF

SEQ ID NO: 210 - DNA, 246 bp, Brassica napus
atggattatgatgacagtgactttcaaaaccacaatctccatttagctggtgaagctaacactaagtttcctccggtgtctcttccaaggtttgattttgacgagaggtttgatagtttagtcgaaactgagggttttcttggtattgagggtaacgaagatagtaactggattgaggatttctctcgtggaagtagtggtgtaggtgttaagctcagctgcaacagagtcttgtgccatttctag

SEQ ID NO: 211 - protein, 81 aa, Brassica napus
MDYDDSDFQNHNLHLAGEANTKFPPVSLPRFDFDERFDSLVETEGFLGIEGNEDSNWIEDFSRGSSGVGVKLSCNRVLCHF

SEQ ID NO: 212 - DNA, 2418 bp, Glycine max
atgattgtacgattggggaatagggattcacccatggattatgatgacaatgattttcaaaaccagaatctccatttagctggtgaagggagtgccaaatttcctccagtattaaggccatatgctctcccgaagtttgattttgatgaaagccttcaagcaaatttaagatttgatagtttagtagaaactgaagtttttcttggcattgaaagtaacgaagataaccagtggattgacgcattctcccgagggggtagtggcatagagttcagttcaactgcagccgagtcttgctctatatcaaggcatggcaatgtttggtctgaggcaacttcctcagaatctgttgaaatgcttttaaaatctgttgggcaggaggactatattcctagacaaacagttattcaggaatcagatgcctgtgatgaactggcctgcttagctaagcaaatggacaccaatccaaaatttgatgataaaaatgaatttagaagtagtgtttcagatttacatccacctggtggtatccatactggtttttctggattgaaagaggatgtaggaatggagaagcctcatggtggagtctcccaaggtcatgaaggggaatcatccattgatggaacttcaagtaaccccaaactaagtgatatctgcagaaatattgacttgcctgtgtctgaggggagtctgactcttgataccaatgacaaaaataacaatacaaaccaaagagaagttgagactgttgatgatgactcacatcatggcaaaactcaagatgattcatctgcagtgcaaactaatattgctgaatcatctataaaaaatatgggtgatgacaagagagatcctttacaagcacaaacttataatcaagatttggaatcttctctgatggataaagaagctgttgtggacacacaaactctggatcgagacatggttgggagtgatgcacatcatctggataaacccctttgttcaatccccacagaagaaaatttggaagggggtgtagttgaaggtcttgagactgggttaagtagtttagagggttccttaacaatggaatctgttgctgcttctggctcgccgaaagttgaaaaaaccagtgaagatatgtgtttcagtgctctgtctcagaacaatgtaagtgaagatgtaatgttgcttaacgatgtggaaatggatgaccagtctgcaccaaatacatgtgtattgccaaaatcttcaagtaaagatgattctatctcggaggggcaagcagttgaggttagtaatttaaattgtgaaaattgtccaaatatgcaccagaatgtggatgtcatagagaagacgacacatggcggcagcagtgttactaaggaagatgagctattgaacactggtgatcatgtggatacagtgattttgtcaagcaagtcagagacatctatgcctactgcagaagaaagtaacatttccactattaatgaaggaaatagtgacaatatggtaggaagtttttcaagtagcagtgcgacggccttttcaacaaaatcttccattttgggtgagtctactcaaatatgtgtaaacaatgaacctgacagacagaatgaccatgaaaaatgtgatctagatgtctctgtcaatgatcaggatgaactaatgaacactggtgatcatgtggatacagttatattgtcgaacaagtcagaggcatctatatttacttctgaggaaaataacatttcctccatccgtgaaggaaacagtggcaaaaaggtagaaggttttcctagtggcagtgtgaaggatttttcaacaaaatcttccattttgggcaagtctactcaaatatgtgcaaacaatgaatctgacagacagaatgaccaggaaaaatgcgatcaagttgtctctgtcaatgatcaggagcatgaaaaggttccttctgattctagccagaagcattgtgatgtcgataagggtgttgtttcatcatctattagtgaaggtagcatggaaatcaagttgatggattatgatgacaatgattttcaaaaccagaatctccatttagctggtgaagggagcgccaaatttcctccggtattaaggccatatgctctccccaagtttgattttgatgaaagccttcaagcgaatttaagatttgatagtttagtagaaactgaagtttttcttggcattgaaagtaacgaagataaccagtggattgacactttctcccgagggggtagtggcatagagttcagttcaactgcagctgagtcttgctctatatcaaggcatggcaatgtttggtctgaggctacttcctcagaatctgttgaaatgcttttgaaatctgttggacaggaggactatattcctagacaaacagttattcaggaatcaagatgcctgtga

SEQ ID NO: 213 - protein, 131 aa, Glycine max
MDYDDNDFQNQNLHLAGEGSAKFPPVLRPYALPKFDFDESLQANLRFDSLVETEVFLGIESNEDNQWIDTFSRGGSGIEFSSTAAESCSISRHGNVWSEATSSESVEMLLKSVGQEDYIPRQTVIQESRCL

SEQ ID NO: 214 - DNA, 4911 bp, Medicago truncatula
atggattatgatgacaatgattttcaaagccagaatcttcatttagccggtgaagggagtaacaaatttcctccagtattaaggcaataccccaagtttgattttgatgaaagccttcagggtcatttaaggtttgatagtttggttgatactgaagttttccttggcattgaaagcaacgaagataatcagtggattgacgcatactcccgggtaagtagtggcacagagttcaattcaactgcagctgaaacttgctctacgtcaaggcataataatgtttggtctgaggcgacttcctcggaatctgttgaaatgttattaaaatctgttgggcaggaggacattatccccaaagaagctattgttatagaagagtcagatgcctgtgatgaattagccaagcaaatggatcccaatcaaaaacctgatgagaaaattgagtttaaagataacattactgatacacagccacccagttgtattcatgaaagcttgtccagatcaaaagaggatgtagaaatggagcagtctctggccggagtttcccaaggccgtgaaggtgaatcatccatagatggaagtttaaataatatgaaaccacctgatatgcatcgcaatattgacttgcctgagtctggggggattctctttgatacaaaccaaaggaaagttgaagttccagctgatggttctgtacatgaaaaaactaacgataactcatctgcttccgtggcgatgactaatacgaatgaagcttctacagaaaatatctctacctgtgaagtcttaaaaattcaaaatgtgcaaaatcaaatagttggcctgggtgacgacgaccaaagttctttacaaacacaaattagtaagcaggatttggagtcttccgtgaacatcaaagattttaatgctggcactcaaactttagatgtaaatacagttgagggtgaagcaaatcattctgataacccacctcgtttaatccatacggaacaagctttggaaggtgagagtgtagttgaaggccttgcgactgggataaatactttagagaaatccttgaacaccgtatctaatggtatttctaacctgcagaaaacagaaagaggaagtgaagatgcatgttttagagatttatcccagggaaatgcaaatatagattcattattggttaaagatcctgcggtggataaccaatctacaccaaatacaagcaacatgccaatgattgcaataaacgataattccagttctgaggggaaagatgcatgttttagagatttatcccaaggaaatgctaataacgatgctctattgattaaaggtcctctgacggatgatcaatctgcactaaatacaagtggcattccaaagattgccatactagatgattctagttctgaggtgcataaagttgaggtcagtaattctgattgtggaacttgtcctaattatcagccgaatacggtgatgattgagaagacatttggtgagagcagtgtttgtaaggagaaggagttggtaaacattggtaaccagatggatacagaggatttgttaggtaagtcagaggcatctatgcttgctgtggtggacaaaaacacttctatagccagtgaaggaaatagtgataacagagcaagttttttcactttcaatacaatggtttctacagagtctcacattttgggcgagaccactcaagtatgtgaaaataacaaatctgacgagcataaagatttttgtcaagacatttttgtcattgaccaagggcgtgaaaaggctccttttgattcgagcacaattccttgtgatgttgatcaattccatcttgctgacaagagagtttgttcatcatctcttggtgcaggtagtgttgaaacctccacagtatcggtcgatgtcacgccggtcaacagttcagatcaccatgagcttgaaaggatgaagcatgttgagcctgcttctgttgatgaaaaggaagactttgaagccaaagtagatgaagaagcaggtgattcttttcctgttgggtcttctgaactggaagttgatccctgtcctgttgctggaactaaaagtaaaaaaaattccgataatctggataatctgcatattactgctactaaaaagattggtgaacctcaagaaagacaaagtagtgaggttgatcacgagtgcacaaaagattctagtatggctactgatctatgtgaatcactagagaaacagggtgatgaagttactgtttgttttattaaggatgataaggaggcaatgtctgacactagggattcacccatggattatgatgatagtgattttgaaagccagaatcttcatttagctgctgaagggaacaccaaatttcctccagtatatgctctccctaagtttgattttgacgaaagccttcaatcaaatttaagatttgatagtttggttgagactgaagtttttcttggcattgaaagtaacgaagataaccagtggattgacgacacattttcccgtgcgggtagtaacatagagttcaattcaactgctgctggatcttgctctatatcaaggtatggcaatgtgtggtccgaggctgcttcctcagagtctgttgaaatgctcttaaaatctgttggacagggggagtatattcctaggcaaactcgggaatcgggtgcttgtgatgaactggcctgcttagctaagcaaatggactccaattctaaacccgatgatagaaatgaatttaataataatgttacaaatttacagccaccttttgatacacatacaagtttttctggattgaagaaacatgtaggaatggagcagtctcagacaggaatttcccaaagtcatgatggtgaattttccttcgatggaagttcaggtattccggaaccaaatgacatgttccgaaatattgacttacctatggctgagggtagtccaactctctttacaaatgataaaagtaacattactaaccaaagagaagttgagactgtggctgatgtctcagatcatggtgaaactcacgattcatcagcacttgtggtggaaactaatattactgaatcatctctgcaaaacattgacctgcctatgtctgagggtagtccaactatctttaccaatgataaaagtaacattagtaaccaaagcgaagttgagactgtggctgatatctcgggtcatggtgaagctcatgattcgtcagcactagtggcggaagctaatattactgaatcatctgtgcaaaatatggttgatgagcaacaaggttcacaacaagcacaaactaataatcaaaatgtggaatcttctatgatgaaggaggaagctgttgtagacacacagactctggatcaaaatgcagctagtgttgatgcacatcatccggataaatctctttttccaacacccccacaagactctttagaaggagggagtttagcgaaaggaccggagaccgggttaagtagtttagaggattccatgggaataagaaccgttgcagtttctgacatgcagaaagaagaaagatgcagtgaagacatatgttcccgtgatctgtctcaggaaaatccaagtgaaaacttagttttgcttaaagatgcggaaatggaggatcagtccgtaccagatacttgcatatcaccaaaggtttcagttaaagatgattctttctctgccgggcaggtgattgaggatagcaagtccagtcatggaatttgtcccaatctccagcaaactgtggatgtcattgagaacaaaacttacagtgcaagcaatgttcttaaggaaaatatttcattaaacactggtgaccacatggattcagggattttatctagcaagttggagtcatctatgtttcctgcagaggaaaatagcatttctattgttagtgaaggaaataatgacaacagggttggaggtttttccagtttcagtttggtggcttcttcaagaaactcttccattgtgggtgaatcgactcaaacatgtgtaaacaatgaacctgataggcaaagtgacccagaaaaatttgaccaagatgtttctgtcaatgatgaaaagaatacaaagattctttctgattctagccaaatgcattttgatgttgcccaatcccatcttggtgataagggagttgtttcatcgcctcttagtgcaggtagcatggaatctgagttgacaacttccactgtatcaatcaacgtcaaacctgcctataattcagcatcgcaaattatttcagaaaatactagtttgacatcctgtgagatgatgaatgatccacctcctagtgaagttgtttcaattcatcgagcgactggtgacaacgatattcaaagggtaactaccgttgaatcaccttctgccgagggaaaagaagaaattgaaatgacaataacagagaaagctggaatatcggctcttgttgggtcttctgaacaggaaactgctccttctcctgttaaggaaacagaaaaacttcatccttctggtactactggacatttgaaatgtgacttgacagtaacagaggaagctggaatatcggctcttgttgggtcttctgaacaggaaactgctccgtgtcctgttaaggaagcagaaaaacttcatccttctggtactaccggacattttatatgtgacatagcaagtgacagtaggcctgatgttgcgactcatggtgctgcaaaaattggggaaccgcaaagaacaacaaatgagaaggttaccgaggaatgcacaaaagatattagtatgcctccagttctatgtgaatcatcagagaaacagggtgacggtgtcataatttctgttattaagaatgataaggagactttacaagaggttcatgaaaagtcgtcctcgaaagaattaggtaaccactaa

SEQ ID NO: 215 - protein, 877 aa, Medicago truncatula
MSDTRDSPMDYDDSDFESQNLHLAAEGNTKFPPVYALPKFDFDESLQSNLRFDSLVETEVFLGIESNEDNQWIDDTFSRAGSNIEFNSTAAGSCSISRYGNVWSEAASSESVEMLLKSVGQGEYIPRQTRESGACDELACLAKQMDSNSKPDDRNEFNNNVTNLQPPFDTHTSFSGLKKHVGMEQSQTGISQSHDGEFSFDGSSGIPEPNDMFRNIDLPMAEGSPTLFTNDKSNITNQREVETVADVSDHGETHDSSALVVETNITESSLQNIDLPMSEGSPTIFTNDKSNISNQSEVETVADISGHGEAHDSSALVAEANITESSVQNMVDEQQGSQQAQTNNQNVESSMMKEEAVVDTQTLDQNAASVDAHHPDKSLFPTPPQDSLEGGSLAKGPETGLSSLEDSMGIRTVAVSDMQKEERCSEDICSRDLSQENPSENLVLLKDAEMEDQSVPDTCISPKVSVKDDSFSAGQVIEDSKSSHGICPNLQQTVDVIENKTYSASNVLKENISLNTGDHMDSGILSSKLESSMFPAEENSISIVSEGNNDNRVGGFSSFSLVASSRNSSIVGESTQTCVNNEPDRQSDPEKFDQDVSVNDEKNTKILSDSSQMHFDVAQSHLGDKGVVSSPLSAGSMESELTTSTVSINVKPAYNSASQIISENTSLTSCEMMNDPPPSEVVSIHRATGDNDIQRVTTVESPSAEGKEEIEMTITEKAGISALVGSSEQETAPSPVKETEKLHPSGTTGHLKCDLTVTEEAGISALVGSSEQETAPCPVKEAEKLHPSGTTGHFICDIASDSRPDVATHGAAKIGEPQRTTNEKVTEECTKDISMPPVLCESSEKQGDGVIISVIKNDKETLQEVHEKSSSKELGNH

SEQ ID NO: 216 - DNA, 5052 bp, Oryza sativa
atggattatgatgattctgattttcagagccagaatttccagttagctggtgaagacaacaataaattcccagcaggtctgcggcaatttccactgcccaaacttgacatcgacgaccaactacaaagccacctcagatttgataacctaattgattcagagggactttttagcggacaaggtcacggcaacagttggattgaggttttgtccactggaagtagtgttgttgattttagttctagtgctgctgaatcttgctctataaataggacaaataatgtatggtctgaggcaacatccactgaatctgtggaaatgttattgaagtcagtgggtgaaaatgagatgaccggtaacatggatgagaacgcacatcatcagattagtggaatggacagtaaaactgatccatccaacatgccgtccaaaacaagtgattctcccacaggcaacattatagtaccagctgagaatgataagtctcagagcactcgttcggaaatggcagaagatccttcaaggattcagcctcagcttgagcatatcagacctttctcagtggatgacaaagctgaacaagcagtaggttcaactttatcagacagaaaatctaactatacgctggaatctgtttctgagaggtgcatagtgagtgggaggtcttcttctccaaagaaaacatcagaaagctgtccagatgttggcagctattttgaggtggtccatgatgacgattctttggacaacctcaacatacagtcagatggagtaggttctagaaagttgaataatgaacccttctcagacttggcaccattacagaacatttatactaccagctcatatcactttgagcaggacaatcaagaatcaggagttggtgttaccactcaaggttcagaaatatgccacacgaatgaaaataaagatggacttcatgatttgcaaaatttgtcatgtacaagccagcatttgggttcttcaaacttaactagtgaagttagcaatgaaactttattgtcgggaagttctgatggattactggaggccatcacaaatccagtaaagatgctgcacaggagtgatgacactagtaagagagccagtgctacactgcaatcatctttcttacaagtcgagcatgcatcagaaggcacaaaaggttctattgacaggagcagtgagcccgccatgaagaaatttggtgctagtgaagaacccaattctgctaaatctcaaggtgagccagatttgaaaaattctagtcctcatcttgtcattcctttgccaaccataagtggtgagtttattcagtctccaaaaggaaaacagcttgctcatgttgctggagtttctgaagaaaccaaatatgacagggtggatgatacgaaccatagcactagtgatgactcaaaacttgccatgttggagcagcttcaagattctgttgataatctatctagtggtgttatggaagagaagacaatcagagggcaaatctcagctgtttcagggaacgttgtacatgtagtgaaaagtggtcattgtgaaaaagttgcagtttctaccagtacaacagatgataagtttgagtcaccgggtgatattgtgcctgacaattcttcagcttgtttacctgatgaaaaagacccaagcatcacagttaaccacgaggtgtcattcaaggaaggtgttgtgcctgcattagaagacgatcctgagaaaatgtcctcaatgaatcatgaggagccattgaaggaagatgataaatctactttagaagttggagaacacaataccacatctcctgtttctgagcccttgctgatgggatcaacaggatcagtgaatccgaacattgatactatttgtagcagtggtactgatgctgttgcagaaacaccacaatgcgaagaacaggccacttcttcgggtagtttgaccacaaatgcaactcaggataaactaggtgatcatccagacgcttgtccaccgaaagtcttgactactgggcctttgatgcaacctgaggatcatgaagatttagttgcaccatcctctgtcttgggtgcctcgtctgaaaagggtgaacaaaataacggaaaagttcccttgaatgggatggatgattcgggtgtgcagttacaagataaggtattaagtcatggtggagatcgtactcttgttactgtttcatcagagaataagaatggcttagaacatgggactggtgaaggaagctgcactgatgctacatgtggttcgcctacagtgattagttgcaatgaatcctgtccagaagaagatgggcagggcagtaatgctttgcttcatcacaaacaaaccgaaccacccaaggatcctaaagatcatacagcttcgactaacaattcccatgtctcaaaagaaggttcttccagaaatgtaaaacctactcttacttcggaggagacgcatacagccgaagataaaagtttttcatttgaggttggagctccactaaatataactgagaaagctcatgctcctgcttggagcccattgcctcgacctgaagttgctcagagtcccgaggtaaccactggaattcctaaacctggaaatccatcgaatcatggtagtgatgaaagtaagaatttggcgattgtggagaccagcaaagaacaactatctggaaggaaagtggttggaagtgctgaggggtcttctgtaagctcacatattggtcatatcactaaagccaaaagtacaccactagagcaggaacaacaacatccaactcctgatgtcaatgctttggggcaccaacctttcacagatttacagcatgtgcagctacgtgcacagatatttgtttatggagctctcattcaaggaatgccaccggcagaatcttacatggtgtcagcttttggagaacctgcatgtggtcgtaagcctccatgggggacacttttgcaagctgctttggaaagatataatagtcagaggtcatctttaactggcttggagactcctacaagctcacatataggtagccgtgtgacggaaaaagccagtagaagcacagcggttaaaactgcaccagctagcaaaaagggtggcaaaactgtgttgccagcacatactgctgtgccccttcatttgccaactttaaatatgtctcctcttggtagttctgctttgagcttgccacgaggtactcatctggattttggccaggctgtatcaccagtattcccatacagttcacagacaaggcagcctacttctggtgttgcatcgtggtttccccagagccctggtgggcgcgctgccccctggttggttcaaccacagaatttgatatttgattcatcgatgaaaccgcctgtgccggcaagtgcaaatgaaactgcaaagggagcatcctctaaaaacatatccatttcacaagctgtttcacctgttgcattccctccgaatcaggcgccttctaccatttctccattagcagtcatacctgaggaaaaacagaaggcatcggtttctacttctaagcgtggagctacaccacaaaagtcaagaaaaagaaagaaagctccagcaagtccagaacaacctatcattgcccctctgctcaaaacagatattgcatctgttactcctgccactcagcatacaccaggcttcaccttatccactcattctccaagcaatattttggccagtgggcttgtttctaacacaggcttggtcacccctgtgcctaattatcagattactggtatcaaggatgcagagcaaagaatcttttcagaacagatctctggtgcaatagagcaatcaatgggacaagcaaaaggggcaggtgtgcatgcgatggatgcagttaggcatgctgaaggtatttggagccacttatcaacaaattcgaaaggcaaattacctgcagaagtagaagagaagcttacttcagctgctgctgctgcttctgcagcagtttctgttgcaaaggcagctgctgaagctgctaagatggcctcagaggctgcattgcaggcaaaaatgatggcagaggaagtcctttcttctacctatgcaaattcctctcagaagcatgatgctggtgaatttaaagtcagtaacaacctggctagtttctcaagtttgacacccacatcgtcttggaaaacaaaggatgacatttccaagggttccattatttcagtggcacgggaggttgctagaaagagggttgaagaggcagcagcagctgcaaaacgtgcagaaaacttggatgccattctgaaagctgcagaacttgctgcagaggctgtgttcaaagcaggaaccatcattggtatgggtgaacctttaccttttacccttagtgagctgttggaagctggtcctgatggttactggaaatctgatcaagtgaggaataagaaggctacaaaattggaactacctactgattttagtaaatctggaaggaagcgtggtggcaaagctaaacatgaccatgcaatacagaacttagagccatcttctagtggcaaagggttgcagctagatgtagtgcattcagggaacgtggctgaagatgttcccaccattgctccagtcaatgggaacagaaatgatgcagcaccgaacataatctggaatggcattgaaaagggatctgctgttgaggttttagttcacaagggtgagtctggagtagcttggttttctgccaaagttcttgatataaacaatgatagtgcatgtatcagctacgactctcacactgaagaaactggtcttcgcaaagaatgggtgccattgagacaggaaggggagaaggcacctcaaatccgccttgctcatcctgcaactgtttctagatttaaaggaactaggaagcgccgtagggacacatcaggaaattactcttgggctattggtgatcatgtggacgtattgattgaagatagttggcgagagggaattatttctcgcaaccgtgatggtgatgaaacaaagcttaccgtacaattttcaggtatcatagtaatgtga

SEQ ID NO: 217 - protein, 1683 aa, Oryza sativa
MDYDDSDFQSQNFQLAGEDNNKFPAGLRQFPLPKLDIDDQLQSHLRFDNLIDSEGLFSGQGHGNSWIEVLSTGSSVVDFSSSAAESCSINRTNNVWSEATSTESVEMLLKSVGENEMTGNMDENAHHQISGMDSKTDPSNMPSKTSDSPTGNIIVPAENDKSQSTRSEMAEDPSRIQPQLEHIRPFSVDDKAEQAVGSTLSDRKSNYTLESVSERCIVSGRSSSPKKTSESCPDVGSYFEVVHDDDSLDNLNIQSDGVGSRKLNNEPFSDLAPLQNIYTTSSYHFEQDNQESGVGVTTQGSEICHTNENKDGLHDLQNLSCTSQHLGSSNLTSEVSNETLLSGSSDGLLEAITNPVKMLHRSDDTSKRASATLQSSFLQVEHASEGTKGSIDRSSEPAMKKFGASEEPNSAKSQGEPDLKNSSPHLVIPLPTISGEFIQSPKGKQLAHVAGVSEETKYDRVDDTNHSTSDDSKLAMLEQLQDSVDNLSSGVMEEKTIRGQISAVSGNVVHVVKSGHCEKVAVSTSTTDDKFESPGDIVPDNSSACLPDEKDPSITVNHEVSFKEGVVPALEDDPEKMSSMNHEEPLKEDDKSTLEVGEHNTTSPVSEPLLMGSTGSVNPNIDTICSSGTDAVAETPQCEEQATSSGSLTTNATQDKLGDHPDACPPKVLTTGPLMQPEDHEDLVAPSSVLGASSEKGEQNNGKVPLNGMDDSGVQLQDKVLSHGGDRTLVTVSSENKNGLEHGTGEGSCTDATCGSPTVISCNESCPEEDGQGSNALLHHKQTEPPKDPKDHTASTNNSHVSKEGSSRNVKPTLTSEETHTAEDKSFSFEVGAPLNITEKAHAPAWSPLPRPEVAQSPEVTTGIPKPGNPSNHGSDESKNLAIVETSKEQLSGRKVVGSAEGSSVSSHIGHITKAKSTPLEQEQQHPTPDVNALGHQPFTDLQHVQLRAQIFVYGALIQGMPPAESYMVSAFGEPACGRKPPWGTLLQAALERYNSQRSSLTGLETPTSSHIGSRVTEKASRSTAVKTAPASKKGGKTVLPAHTAVPLHLPTLNMSPLGSSALSLPRGTHLDFGQAVSPVFPYSSQTRQPTSGVASWFPQSPGGRAAPWLVQPQNLIFDSSMKPPVPASANETAKGASSKNISISQAVSPVAFPPNQAPSTISPLAVIPEEKQKASVSTSKRGATPQKSRKRKKAPASPEQPIIAPLLKTDIASVTPATQHTPGFTLSTHSPSNILASGLVSNTGLVTPVPNYQITGIKDAEQRIFSEQISGAIEQSMGQAKGAGVHAMDAVRHAEGIWSHLSTNSKGKLPAEVEEKLTSAAAAASAAVSVAKAAAEAAKMASEAALQAKMMAEEVLSSTYANSSQKHDAGEFKVSNNLASFSSLTPTSSWKTKDDISKGSIISVAREVARKRVEEAAAAAKRAENLDAILKAAELAAEAVFKAGTIIGMGEPLPFTLSELLEAGPDGYWKSDQVRNKKATKLELPTDFSKSGRKRGGKAKHDHAIQNLEPSSSGKGLQLDVVHSGNVAEDVPTIAPVNGNRNDAAPNIIWNGIEKGSAVEVLVHKGESGVAWFSAKVLDINNDSACISYDSHTEETGLRKEWVPLRQEGEKAPQIRLAHPATVSRFKGTRKRRRDTSGNYSWAIGDHVDVLIEDSWREGIISRNRDGDETKLTVQFSGIIVM

SEQ ID NO: 218 - DNA, 5157 bp, Populus trichocarpa
atggattatgatgaaaatgattttcaaaaccacaatcttcatttagctggtgaaggaagcaacaaatttccttctgttttacagccatatgctcttcccaagtttgatttcgatgacagtcttaatggatctttaaggtttgatagtttggttgagactgaggtttttcttggcatcgaaagtaacgaggacaaccagtggattgaagatttctctcgtggtaccagtgggatacagtttagttcaagtgcagcagagtcttgttctctatcaagacgcaacaatgtctggtctgaagctacttcctcagaatctgttgaaatgttattgaaatctgttggccaggaagataatactcctatacaaactaatactaaggagtcagatgcctgtgatgaactgggttgcatactaaagcacatggagcccatcttgaaacaggataatgatacatcacctaaagtggaagatactgcgaatttacaggctacatttctgccaggcgaggatgtggaagatttttctgtgttggataatgatgttggacagcagcagcctcttgatgatagttctcaggatcataaaggtgaagcatctgctgatagtggtttgggacctttagttgacccatctgctgttagtgtagaggtcaggcaacctgttattgaagggagtctgtccattgatagtaaatctaatcatgttactcaaagggaaatcgataatgtcgtgaatggatcttcaaatgataggccacagaaagttcctgcttcagggatgcaggatggtgcctctgtgcaaaatatcactacaggaaatattgaattgaatgaaaaagatggccctgatgatataaataacacttctgatgatagtaaagattttctggaaacagacactggtgagaatcagaaaaagggacaagtattaagtcaagagggccaaatggaggatgagaatccttgttcagatgcagtggaatctatggaagaagcaaacgtcattgaaactaattcgagtaatttgggggaaccttcttgcaaaatactgaaggggcattctggtttcccagaagacgtagtgactagtgatcagtccgaagtggatacagttgggggatcagtgatggctgttgaaggtaatactacttttaagagggatgaaattgaggactcaaatggttcccaattggataacaagaacctatctaataagtgtgagggatctctcctgtctgctgaagactgtgagcctgctaaagtgaaagttggtggaactagcagcagcgatacaggtggtgtttctagtttggctacagtgtgctgttcagctgaagttgttggagaagtggcccatgtttcatcctctttccttgttgaatcatcacaaatatgtgggaagtctatggtttctgctgagggaaaggagaccacagagcttccttctggcaatgttagcactgaaaacaatttcatagcttcgagattacaatcagatgctgcttctgacaacaattcggcatcagatgttagctgcgaacatgctaacatggtaacctgtgctacaatggatggtgttccagcgccttctggtgatgtcactaatgtagatgcagttattggtcacaaagatgtcaaaatgtcacttttaagtgagatggggtttagtcccttagatatagagaaagaaaccgtggacaagatttctgtggaggccagtttatcaggtctgaagacatcttgtcaagtgatagctggattagatcctggttctgaatccaaaaaaggcgcttcttctggtgctgcaggacagatattatgcgagtcagctgaacaatctccattaatggtggatgctagtaaaacagaaggacctcattcagaagtaattgataaggtcagcctgcagagcacaaaggaaatgaatgtgtgtccagttctttgtgattcaactgcaaacaagggtgatgatgctgaagtgtttgtaaaagaaaatgatgaaaaggaatcatccaaagtttcagaaccgactgtaaacaagaatgagatgctaggacctatctcctcagaaaaggaagagtgtcgagaggatactaaccagaaaggtcaggaagaaaatgaagctgccatagtgtctgaagataatagtgatgggaatattgctgtccctagcacaaacgattgtggaagttgtgctgatgttggcaaagcagccagtggttcccctactgtcatcagagccgccagagattttcagagtgaaagtgacaaggatggagccaaatgttcagttgagcagactgctgttgctgatagcaatgccagcaaagctttgtctggttctcgggatccgaaacaaaatgatgcatccaaagatgaaaggagcttcacttttgaggtcagtccattggcaaatatgcctcaaaaagaagttggcaataaatggcagccctttttgaacaaaccagccactaaagcctacccgattttgaatgcttctccatcatcgggtttagtccaaatagatcccaagcttgcccaagatcttcctcatggaagtccaaaggtgtctgatgtagccattgtgcgtagtggttctaaaggtacttctgagcgtaaaacaagacgatcatctggtaaggccatggaaaaggaaagtgcgagaaagggaaatcctattaaagatactgcttctgtgaggctagaaaagggggcaaaaacaaacaatgtctccccaagctcttctgggatattgcaacatgtgcaatcaaatgagatgcagcgctatggtcatgcggattccagtactatgaaaccatttgttcatgcatcttcaagccttccagatctgaattcttctgcttctccatctgtgatgtttcaacaacccttcacggacttgcaacaagtgcaattgcgtgctcagatctttgtttatggcgctttgatacaaggaacagctccagatgaagcatatatgatatcagcatttggaggatctgatggtgggaaaaccatatgggagaatgctctacgctcttctatagaacggcttcatggtcaaaaacctaatctcacttctccagaaacccctttgcagtcacgtcctggtgtcagagctcctgatcaagcaattaaacagagtactgttcaaagtaaagtaatctcttcacctattggtcgatccagcaagggtactccaacaattgtgaaccccatggtacccctttcttcaccgctctggagtgtacctacccccgctggcgacacatttcaatcaagcagcatgccaaggggtcccattatggatcatcagcgggcactttctcctatgcatcctcatcaaactccacagataagaaattttgctggtaatccttggctatctcaggcacctttttgtggtccctgggctacatctccacaaacacctgcacttgacacaagtggtcatttttctgcgcaattgcctatcacagaaccagttcaattgacacctgtgaaagacttatccatgccaattatctctggtgcaaagcatgtttctcctggtcctgtagctcagagtggggcttccaccagtgtttttactgggacttttcctgttccagatgcaaaaaaggctgcagtgtcatccagtcaacctcctgctgatccaaaacctaggaaaagaaaaaagaactcggtttctgagagtccgggccagaatattttgcctcctcaccttcgaacagaatcagtttctgctcctgttgttaccagtcatctgtctacttctgttgccattacaacccctgtcatctttgtttctaaagcccctacagagaaatttgtgacttctgtatctcctacacctactgatatcagaaacgggaatcagaatgcagaacagaggaatattttgtcagaggaaacccttgataaagtgaaggctgcgagagtgcaggcagaggatgctgctactcttgctgctgctgctgttagtcacagcctggaaatgtggaatcagttagataagcagagaaattctgggttatcaccagatattgaaaccaaactagcttctgcagctgtcgcaatagcagcagctgctgctgttgcaaaagcggcagcggcagctgccaaagttgcatctagtgctgcattgcaagcaaaactgttggctgatgaagcagtaaattctggtggttacagcaatcccagtcaagacaatacaatttctgtttctgaaggcatgaagaatttgggaaaggctactcctgcttccatcctgaagggtgatgatgggacaaacagttccagttcaatccttattgtggcaagggaggctgctagacggagagttgaagttgcttccgctgctgcaaaacgagctgaaaatatggatgctattgttaaagctgcggagctggctgcagaagctgtgtcccaagctgggaagatagttgctatgggcgatcctttgccactgaatgagctagtagctgtgggtccagagggatattggaaagtagccaaaataaataatgaactgatctctaaatcaaatgatataggtagaaaaactcttaatatagatagagttggagaaagaccacgcactccaactgaggggtccactgaggaccatgttagattggaagatggtttcttgagttctggtgcagctgctgcaaaggatgttaaaggacaaaagggctacaaggtgtctgaatctgagaatggtttaagatctttgggaactatagaaaactttaatagcatcaaggaggggtcccttgtagaggttttcaaagatgggaatggatttaaagcagcctggttctctgccaatgtcgtggatttaaaggatgggagtgcatgtgtgagttatactgatctttcatcagttgaaggctcagagaagctaaaggagtgggtgacacttaaaggtgaaggagagagagcgccaaaaatacgaatagctcgccctattactgccgtgcaattagaaggaacaaggaagaggcgacgagctgccacggtggaccatatttggtctgttggtgatagagtggatgcatggatacaagatagctggtgggaaggagtggtcattgaaaggagcaagaaagatggcaccacactaacagtccaatttccaggcatgtacaattga

SEQ ID NO: 219 - protein, 1718 aa, Populus trichocarpa
MDYDENDFQNHNLHLAGEGSNKFPSVLQPYALPKFDFDDSLNGSLRFDSLVETEVFLGIESNEDNQWIEDFSRGTSGIQFSSSAAESCSLSRRNNVWSEATSSESVEMLLKSVGQEDNTPIQTNTKESDACDELGCILKHMEPILKQDNDTSPKVEDTANLQATFLPGEDVEDFSVLDNDVGQQQPLDDSSQDHKGEASADSGLGPLVDPSAVSVEVRQPVIEGSLSIDSKSNHVTQREIDNVVNGSSNDRPQKVPASGMQDGASVQNITTGNIELNEKDGPDDINNTSDDSKDFLETDTGENQKKGQVLSQEGQMEDENPCSDAVESMEEANVIETNSSNLGEPSCKILKGHSGFPEDVVTSDQSEVDTVGGSVMAVEGNTTFKRDEIEDSNGSQLDNKNLSNKCEGSLLSAEDCEPAKVKVGGTSSSDTGGVSSLATVCCSAEVVGEVAHVSSSFLVESSQICGKSMVSAEGKETTELPSGNVSTENNFIASRLQSDAASDNNSASDVSCEHANMVTCATMDGVPAPSGDVTNVDAVIGHKDVKMSLLSEMGFSPLDIEKETVDKISVEASLSGLKTSCQVIAGLDPGSESKKGASSGAAGQILCESAEQSPLMVDASKTEGPHSEVIDKVSLQSTKEMNVCPVLCDSTANKGDDAEVFVKENDEKESSKVSEPTVNKNEMLGPISSEKEECREDTNQKGQEENEAAIVSEDNSDGNIAVPSTNDCGSCADVGKAASGSPTVIRAARDFQSESDKDGAKCSVEQTAVADSNASKALSGSRDPKQNDASKDERSFTFEVSPLANMPQKEVGNKWQPFLNKPATKAYPILNASPSSGLVQIDPKLAQDLPHGSPKVSDVAIVRSGSKGTSERKTRRSSGKAMEKESARKGNPIKDTASVRLEKGAKTNNVSPSSSGILQHVQSNEMQRYGHADSSTMKPFVHASSSLPDLNSSASPSVMFQQPFTDLQQVQLRAQIFVYGALIQGTAPDEAYMISAFGGSDGGKTIWENALRSSIERLHGQKPNLTSPETPLQSRPGVRAPDQAIKQSTVQSKVISSPIGRSSKGTPTIVNPMVPLSSPLWSVPTPAGDTFQSSSMPRGPIMDHQRALSPMHPHQTPQIRNFAGNPWLSQAPFCGPWATSPQTPALDTSGHFSAQLPITEPVQLTPVKDLSMPIISGAKHVSPGPVAQSGASTSVFTGTFPVPDAKKAAVSSSQPPADPKPRKRKKNSVSESPGQNILPPHLRTESVSAPVVTSHLSTSVAITTPVIFVSKAPTEKFVTSVSPTPTDIRNGNQNAEQRNILSEETLDKVKAARVQAEDAATLAAAAVSHSLEMWNQLDKQRNSGLSPDIETKLASAAVAIAAAAAVAKAAAAAAKVASSAALQAKLLADEAVNSGGYSNPSQDNTISVSEGMKNLGKATPASILKGDDGTNSSSSILIVAREAARRRVEVASAAAKRAENMDAIVKAAELAAEAVSQAGKIVAMGDPLPLNELVAVGPEGYWKVAKINNELISKSNDIGRKTLNIDRVGERPRTPTEGSTEDHVRLEDGFLSSGAAAAKDVKGQKGYKVSESENGLRSLGTIENFNSIKEGSLVEVFKDGNGFKAAWFSANVVDLKDGSACVSYTDLSSVEGSEKLKEWVTLKGEGERAPKIRIARPITAVQLEGTRKRRRAATVDHIWSVGDRVDAWIQDSWWEGVVIERSKKDGTTLTVQFPGMYN

SEQ ID NO: 220 - DNA, 1542 bp, Brassica napus
atgatgatgttgcgcgtgtgtccgtcgtctctcttctatctccgaccacttcatctctccacttcctctgcgaaattccctttttgcccctctattcgccgagaattacgattagtcccttcccgatcttcttcttcttcgttccgtcggatggaatcttctccggcttcggaaacggattccttaggggaagatatgcagaatcaaactgatgaaggtgataagatcaaaaggaagctcgaagagtttaactgggaccactcctttgttaatgagctgcctggtgatccgagaagcgatgttatctcgcgtaaggtatttcatgcttgctattcaaaagtttccccgtcagtacaagtagatgatcctcagcttgtagcatggtctgattctgttgcggagctcttggatctacatcctaaagaatttgaaaggcttgatttccctctcctactctctggtgctaaacctttgcctggagcaatgccttatgctcaatgctacggaggccaccagtttggcaggtgggctggacagctaggcgacggtcgcgccattactctcggagaagttctgaactccaaaggcgaaagatgggagcttcagctcaaaggcgctggtagaactccttacagccgtttttcagatggcctcgcagtgcttcgtagtagcatcagggagttcctctgcagtgaagccatgcattgtcttggaatccccaccactcgcgccctttgtctcctcacgacaggtcaaggtgtcattcgcgacatgttttatgatggcaatgcgaaggaggaacctggtgctatcgtttgcagggtttctcagtcatttatccgcttcggctcgtaccaaatacatgcttctagaggaaaagaggaccttgagattgttgggaagctagcagactatgccattagacatcatttcccacgtatagagaagagcatgaacagaagtgatggcttatctttcaaaaccggtgatgatgatgatgattctgttttggatctaacatcaaacaagtatgcagcatgggttgttgaagttgcggagcgtacagctactttatttgcaagatggcaaggtgtaggattcacacatggagtgctcaacactgacaacatgagcattttgggtcaaaccattgactatggcccgtttgggttcttagatgcttttgatccaagttacaccccaaacacaacagacctccctggaagaagatactgttttgctaatcagcctgacatcggcttgtggaatattgctcaatttgctgaggctctggctgctgctcagctgataaatgaaaaggtggctaattacgccatggagaggtacggtgataagttcatggatgagtatgaagccataatgacaaagaagcttggtctttcgaagtacaacaaggagatgattagtgaacttctgaacaacatggctgttgataaagtcgattacacaaacttcttccggcttctttcgaatgtaaaagcagaccccaacacatctgatgatgagttattaaacccttga

SEQ ID NO: 221 - protein, 513 aa, Brassica napus
MMMLRVCPSSLFYLRPLHLSTSSAKFPFCPSIRRELRLVPSRSSSSSFRRMESSPASETDSLGEDMQNQTDEGDKIKRKLEEFNWDHSFVNELPGDPRSDVISRKVFHACYSKVSPSVQVDDPQLVAWSDSVAELLDLHPKEFERLDFPLLLSGAKPLPGAMPYAQCYGGHQFGRWAGQLGDGRAITLGEVLNSKGERWELQLKGAGRTPYSRFSDGLAVLRSSIREFLCSEAMHCLGIPTTRALCLLTTGQGVIRDMFYDGNAKEEPGAIVCRVSQSFIRFGSYQIHASRGKEDLEIVGKLADYAIRHHFPRIEKSMNRSDGLSFKTGDDDDDSVLDLTSNKYAAWVVEVAERTATLFARWQGVGFTHGVLNTDNMSILGQTIDYGPFGFLDAFDPSYTPNTTDLPGRRYCFANQPDIGLWNIAQFAEALAAAQLINEKVANYAMERYGDKFMDEYEAIMTKKLGLSKYNKEMISELLNNMAVDKVDYTNFFRLLSNVKADPNTSDDELLNP

SEQ ID NO: 222 - DNA, 1773 bp, Glycine max
atgagatatgagatgggagtctccattctcacccgtttccatttctctctccctctcccacgcgccaccgccagaaagaggattttccatttctgccctccgattgcatgccgctcatccatggatcagtcttctggcctgaatctggaagatctgaaatgggaccattccttcgtcagagaattgcccggcgatccccgccgcgactcctttccccgtgaggttctgcatgcttgttacacccaagtctctccttctgttcaagtacacaatccccaacttgtagccttctcccaaccagttgccgacctacttgatctcgaccataaagaatttcagaggccagattttccccttttcttctctggtgccacacctttagttggagcgttgccttatgctcagtgctatggcgggcatcaatttggtatgtgggctgggcagctgggtgatggcagggcaatgactctaggggagatactgaattctaactctgaaaggtgggaacttcaacttaaaggagctggcaagactccttacagtcgctttgccgatggccttgccgtcctccgcagcagcgtcagggagttcctttgcagtgaggcaatgcaccaccttggtataccaacaactcgtgcactttctcttgttaccaccggcaacctcgtcacccgtgacatgttttatgacggcaatccaaaggaagaacctggcgcaattgtttgcagagttgcccaatcttttctgcggtttgggtcataccaaatacatgcctccagaagtgatgaggacctaggccttgttcgtgttttggcagactatgctatcaggcaccactttcctcatattcaaaatatgagcaagagtgatagcttatctttctgcactggtgatgaagatcattctgttgtagatctcacttcaaataagtatgcagcatgggtggtggagattgctgagcgtactgcttccctgattgctagatggcagggggttggtttcactcatggcgtgctgaacacggataacatgagcattttgggtcttacaatagattatggcccatttggatttttggatgcttttgatcctaaatttaccccaaatactacagatcttccaggtcgaagatactgttttgcaaaccagcctgacattggtttgtggaatattgcacagttcacaacaacactacaagctgctcatttaataaatgaaaaagaggccaactatgctatggaaagatatggaacgagatttatggatgattatcaggttacaatgaccaaaaagcttggcctccctaagtataataagcagatgattaataaacttcttagcaatatggctgttgacaaagttgattacacaaacttctttcgtacgctttcaaatgttaaagcagacataaacattccagatgatgagctgttagtcccactaaagtctgtactgttagatattggtaaagagcgtaaggaagcatggaccagttggttgaaagcttatatacatgaggtctctaccagtgggatacctgatgacgaaaggaagatctcgatggattcagtgaatcctaaatatatactgaggaactatctctgccagactgcaattgatgctgcagaaataggtgattttggagaggttcgcagcctgctcaaattagtggagcatccgtatgatgagcaaccaggaatggaaaaatatgctcgcttgcccccagcttgggcatatcgaccaggtgtatgcatgctttcttgttcttcatga

SEQ ID NO: 223 - protein, 590 aa, Glycine max
MRYEMGVSILTRFHFSLPLPRATARKRIFHFCPPIACRSSMDQSSGLNLEDLKWDHSFVRELPGDPRRDSFPREVLHACYTQVSPSVQVHNPQLVAFSQPVADLLDLDHKEFQRPDFPLFFSGATPLVGALPYAQCYGGHQFGMWAGQLGDGRAMTLGEILNSNSERWELQLKGAGKTPYSRFADGLAVLRSSVREFLCSEAMHHLGIPTTRALSLVTTGNLVTRDMFYDGNPKEEPGAIVCRVAQSFLRFGSYQIHASRSDEDLGLVRVLADYAIRHHFPHIQNMSKSDSLSFCTGDEDHSVVDLTSNKYAAWVVEIAERTASLIARWQGVGFTHGVLNTDNMSILGLTIDYGPFGFLDAFDPKFTPNTTDLPGRRYCFANQPDIGLWNIAQFTTTLQAAHLINEKEANYAMERYGTRFMDDYQVTMTKKLGLPKYNKQMINKLLSNMAVDKVDYTNFFRTLSNVKADINIPDDELLVPLKSVLLDIGKERKEAWTSWLKAYIHEVSTSGIPDDERKISMDSVNPKYILRNYLCQTAIDAAEIGDFGEVRSLLKLVEHPYDEQPGMEKYARLPPAWAYRPGVCMLSCSS

SEQ ID NO: 224 - DNA, 1935 bp, Gossypium hirsutum
atgagatttcatttctctccaaagacaccgctcttctcactctcttcttcctctatcacttccctttgcctccgtcctttccttccttctgccactaaatcccctttttacccttccctcgcatgccacgtgtccaccggcggcaaccttcgcatggactcgacttcaccggatccctcctcttcctcctccgtctccgttgactccgtcgccgacggtttgaaaaaccaaagcttaagagaacatgatatcagtaataataataatatgaacaatgaaaataagaagaataatggtaaattgagccttgaagatcttaattgggaccattcattcgttagagaactgcctggtgaccctataagcgattcaattccacgtcaggttttccatgcatgttatacaaaagttttgccgtcagctgaagtagagaatcctaagcttgttgcctggtcagattcagtggctgatttgcttgatttggatcccaaagaatttgaaagaccagattttccccttaaattttctggggcctctcccttggcaggagcggtgccatatgctcaatgttatggaggacatcagtttggcacatgggctggtcaactgggtgacggccgtgccattactcttggggagataatcaattcgaaattagaaaggtgggaactgcagcttaaaggagctgggaagacgccatacagtcgatttgcggatgggcttgcagttttacggagtagcatccgtgaatatctttgcagtgaagcaatgcattttctaggaattccaactactcgcgctctttgtcttgtgactacaggaaaatttgtaactcgggacatgttttatgatggcaatccaaaggatgagcctggtgcagttgtttgcagagtttcccagtcctttctgcggtttggttcattccaaatacatgcttcaaggggaggagaggaccttggtattgtacgttcgttggcagactatgccatcagacatcatttccctcacattgagaacatgagcaaaagtgagagcttgtcttttagcactggtgacaatgatcaatcagttgtggatttgacttcaaacaagtatgcagcatggacagtggagattgctgagcgtactgcctctttggttgctagatggcagggagttggctttactcatggtgtgctgaacacggacaacatgagtattttaggtctcaccattgattatggtccttttggatttttggatgcttttgatccgagttacacaccaaatgttacagatcttccagggagaagatactgttttgcaaatcagcctgatattggcttatggaatattgcacaatttgcctcaactttgatgactgccaacttgataagtgatcaagaagcaaattatgcgatggaaaggtatgggacaaaatttatggacgattatcaagcaatactgagccaaaagcttggcctccaaaaatacaataaacagcttgtcaataaacttcttagtaatttggctgttgataaagtggattacacgaacttctttcgggcactttccaatatcaaagcagatcctagcattccaggtgatgagttgttggtgccattgaaagctgttctgctagacatgggcaaggaacgcaaggaggcgtggactagttgggtacaaacctacattcaagagctggttgcgagtggcgtctcagatgaggagaggaaagcttcaatgaactcagttaaccctaaatatgttctcaggaactacttatgtcagagcgctatcgatgcagctgaaatgggtgacttggaagaagtccgaaggctccttaaagtaatggagcgaccatatgatgaacaaccgggaatggaaaaatatgctcatttgcctccagcatgggcttatcggcctggtgtgtgcatgctatcctgttcgtcatga

SEQ ID NO: 225 - protein, 644 aa, Gossypium hirsutum
MRFHFSPKTPLFSLSSSSITSLCLRPFLPSATKSPFYPSLACHVSTGGNLRMDSTSPDPSSSSSVSVDSVADGLKNQSLREHDISNNNNMNNENKKNNGKLSLEDLNWDHSFVRELPGDPISDSIPRQVFHACYTKVLPSAEVENPKLVAWSDSVADLLDLDPKEFERPDFPLKFSGASPLAGAVPYAQCYGGHQFGTWAGQLGDGRAITLGEIINSKLERWELQLKGAGKTPYSRFADGLAVLRSSIREYLCSEAMHFLGIPTTRALCLVTTGKFVTRDMFYDGNPKDEPGAVVCRVSQSFLRFGSFQIHASRGGEDLGIVRSLADYAIRHHFPHIENMSKSESLSFSTGDNDQSVVDLTSNKYAAWTVEIAERTASLVARWQGVGFTHGVLNTDNMSILGLTIDYGPFGFLDAFDPSYTPNVTDLPGRRYCFANQPDIGLWNIAQFASTLMTANLISDQEANYAMERYGTKFMDDYQAILSQKLGLQKYNKQLVNKLLSNLAVDKVDYTNFFRALSNIKADPSIPGDELLVPLKAVLLDMGKERKEAWTSWVQTYIQELVASGVSDEERKASMNSVNPKYVLRNYLCQSAIDAAEMGDLEEVRRLLKVMERPYDEQPGMEKYAHLPPAWAYRPGVCMLSCSS

SEQ ID NO: 226 - DNA, 2367 bp, Medicago truncatula
atgatggtactattaactactagtagtatttgtttccctcgtctgttgtcgttgtatccaaactcactcatccgacgcggcggtggcataaggaaattccatttataccctgttagatgctgcagaatgatgatggattcaacagagaagggattgtcagcaccgttgcttgactctgtaactcaagaatttaagaatcaaagccttattcagaagaagaaacgcgaacttgaagatctgaattgggataattcctttgttagagacttaccctctgatccaagaaccgatccctttccaagagaggtattgcatgcttgctatacaaaagtatcaccatcagtttcagtagatgatccacaactcgttgtatggtctgaatccgttgccgaactacttgacttagataataacgaatttcaaagacctgattttccccttttcttctctggtgcatcaccttttgttggtgccttcccttatgctcaatgctatggtggacatcaatttggtatgtgggctggccagttgggtgatggtagagcaatcactcttggggagatactcaattctaactctcaaaggtgggagctacagcttaaaggtgctgggaagactccttacagtcgctttgccgatggtcttgctgtgctacgtagcagcgtcagagagttcctttgcagtgaagcaatgcatcatctcgggattccaacaacccgtgctctttctcttgtcaccactggaaagttggttactcgagatatgttctacgatgggaatccaaaggaagaacagggtgcaatcgtttgtagagttgctcaatcttttctgcgttttgggtcataccaactacatgcctccagaggtagtaatgaggacctggagattgttcgtgttttggcagactatgctattaaacaccactttcctcatattgaaaacatgagtaagagtgagagcttatctttcagcacgggtgatgaagatcattcagtcgtggatcttacatcaaacaagtatgcagcatgggcggtagagattgctgagcgtactgcttccatgattgctagatggcagggggttggtttcactcatggtgtgatgaacacggataacatgagcattttgggtcttactattgattatggtccatttgggtttttggatgcttttgatcctaaatttaccccaaataccacagaccttccaggtagaagatactgttttgcaaaccagcctgacattggtttgtggaatcttgcacagtttacaacaacactgtcagctgctcatttgataaatgacaaagaggctaactatgctttggaaagatatggaacaaaatttatggatgattatcaagatataatgaccaaaaagcttggcctccctaagtataataaacagctgattggtaaacttcttactaatatggctgttgacaaagttgattatacaaacttctttcgcacactctcaaatattaaagcggacacaagcattccagatgatgaattgcctatatggtccacatgggcggtagagattgctgagcgtactgcttccatgattgctagatggcagggggttggtttcactcatggtgtgatgaacacggataacatgagcattttgggtcttactattgattatggtccatttgggtttttggatgcttttgatcctaaatttaccccaaataccacagaccttccaggtagaagatactgttttgcaaaccagcctgacattggtttgtggaatcttgcacagtttacaacaacactgtcagctgctcatttgataaatgacaaagaggctaactatgctttggaaagatatggaacaaaatttatggatgattatcaagatataatgaccaaaaagcttggcctccctaagtataataaacagctgattggtaaacttcttactaatatggctgttgacaaagttgattatacaaacttctttcgcacactctcaaatattaaagcggacacaagcattccagatgatgaattgttagtgccattaaagtcagtgctattagatattggtcaagagcgtaaagaagcgtggacaagttggttgaaaacctatatacacgagctctctacaagtggcatttctgatgatcagaggaagacctccatgaatatggtaaatcctaaatatattctcaggaactatctttgccagactgcaattgatgctgcagaaatcggtgattttggagaagttcgtaggttacttaaattagtggaacatccttttgatgagcagccaggaatggaaaagtatgctcgcttacccccagcatgggcatatcgaccaggtgtatgcatgctttcttgttcctcatga

SEQ ID NO: 227 - protein, 788 aa, Medicago truncatula
MMVLLTTSSICFPRLLSLYPNSLIRRGGGIRKFHLYPVRCCRMMMDSTEKGLSAPLLDSVTQEFKNQSLIQKKKRELEDLNWDNSFVRDLPSDPRTDPFPREVLHACYTKVSPSVSVDDPQLVVWSESVAELLDLDNNEFQRPDFPLFFSGASPFVGAFPYAQCYGGHQFGMWAGQLGDGRAITLGEILNSNSQRWELQLKGAGKTPYSRFADGLAVLRSSVREFLCSEAMHHLGIPTTRALSLVTTGKLVTRDMFYDGNPKEEQGAIVCRVAQSFLRFGSYQLHASRGSNEDLEIVRVLADYAIKHHFPHIENMSKSESLSFSTGDEDHSVVDLTSNKYAAWAVEIAERTASMIARWQGVGFTHGVMNTDNMSILGLTIDYGPFGFLDAFDPKFTPNTTDLPGRRYCFANQPDIGLWNLAQFTTTLSAAHLINDKEANYALERYGTKFMDDYQDIMTKKLGLPKYNKQLIGKLLTNMAVDKVDYTNFFRTLSNIKADTSIPDDELPIWSTWAVEIAERTASMIARWQGVGFTHGVMNTDNMSILGLTIDYGPFGFLDAFDPKFTPNTTDLPGRRYCFANQPDIGLWNLAQFTTTLSAAHLINDKEANYALERYGTKFMDDYQDIMTKKLGLPKYNKQLIGKLLTNMAVDKVDYTNFFRTLSNIKADTSIPDDELLVPLKSVLLDIGQERKEAWTSWLKTYIHELSTSGISDDQRKTSMNMVNPKYILRNYLCQTAIDAAEIGDFGEVRRLLKLVEHPFDEQPGMEKYARLPPAWAYRPGVCMLSCSS

SEQ ID NO: 228 - DNA, 1881 bp, Oryza sativa
atgcccccacacctctcctcctccctcttctcctcctcccctctccccaccaccctcctctcctccctcacccgccgcgcccgcgccctcctccccctccccctccccctccccgccgcctccacccgccgccgcctccctctccgccgcggcccgctgctgacgcgtggcatcatggcctccgccgccgcagaggcaccggccccgtcgccctcgcccaccgccgccgcgaacagccgaccgcggcgggtgctggaggagctctcctgggacgactccttcgtccgcgagctccccggcgacccccgatccgacgccatcccccgcgaggtgcttcacgcttgttacacaaaggtgtcaccctcagcgcccgtggacaaccctaagctggtggcgtggtcccagtccgtggctgacatcctcgatctggatcacaaagagtttgaaagacctgattttcctcagctgttctcaggagcaaatcctttggttgggagttcaccttatgcccagtgctatggtggacaccagtttggttcatgggctggtcagttgggcgacggacgagcaataactcttggagaggttatcaactctcgaggtgagagatgggagttgcagctcaagggctgtggaaagactccatacagccgatttgcagatggccttgctgtcctccgcagcagcattcgtgaattcctatgcagtgaagctatgcatggcctaggcatccctacaactcgtgctctttgtctagttgaaactggcaaatctgttgttcgagatatgttctatgatggcaattcaaaggaggaaccaggtgccattgtatgccgtgtagcaccatcctttttgcgttttggttcatatcagatacatgctacaagggacaaagaggaccttgaaattgttcgtcatttggcagactacacaatacgtcatcactacccacatctcgaaaatattaaaaagagtgaaggtttatcttttgaagcagctataggggactctccagcgatagatcttacttcgaacaaatatgcagcctgggcagttgaggttgcagagcgcactgctttcttgatagcaaggtggcaaggtgttggttttacccatggtgtgctcaacacggataatatgagtgtattaggactaactattgactatggaccctttggctttttggatgcttttgatcctagctatactccaaatacaacagacctccctgggaagagatactgttttgcaaatcaacctgatgttggcttgtggaatattgctcagtttacctcaccattgacagctgccgaacttatcagcaaagatgaggcaaattatgtgatggagaggtacgggacaaagtttatggatgagtatcaatccataatgaccaggaaacttggtctacccaagtataataagcagctaataggcaagctgcttaacaacctggctgttgataaggtcgattatacaaactttttccgtcttctttcaaatgtcaaagcagaccataacattccagagaaggagctacttgttccacttaaagctgcactcctagatattggaccagaaagaaaggaagcatggattagttgggtacaaacttacattgaagagttggtttcaagtggcgttcctgacgaagaaaggaaagctgccatgaactctgttaatccaaagtatgttcttcggaactatctctgccagactgcaattgacgcagctgagcaaggtgattatgatgaagttcgtcggttattgaaagttatggaacatccatatgatgagcagccaggaatggagaaatatgcccggttgccaccagcctgggcatacaggccaggagtgtgcatgctgtcctgctcatcatga

SEQ ID NO: 229 - protein, 626 aa, Oryza sativa
MPPHLSSSLFSSSPLPTTLLSSLTRRARALLPLPLPLPAASTRRRLPLRRGPLLTRGIMASAAAEAPAPSPSPTAAANSRPRRVLEELSWDDSFVRELPGDPRSDAIPREVLHACYTKVSPSAPVDNPKLVAWSQSVADILDLDHKEFERPDFPQLFSGANPLVGSSPYAQCYGGHQFGSWAGQLGDGRAITLGEVINSRGERWELQLKGCGKTPYSRFADGLAVLRSSIREFLCSEAMHGLGIPTTRALCLVETGKSVVRDMFYDGNSKEEPGAIVCRVAPSFLRFGSYQIHATRDKEDLEIVRHLADYTIRHHYPHLENIKKSEGLSFEAAIGDSPAIDLTSNKYAAWAVEVAERTAFLIARWQGVGFTHGVLNTDNMSVLGLTIDYGPFGFLDAFDPSYTPNTTDLPGKRYCFANQPDVGLWNIAQFTSPLTAAELISKDEANYVMERYGTKFMDEYQSIMTRKLGLPKYNKQLIGKLLNNLAVDKVDYTNFFRLLSNVKADHNIPEKELLVPLKAALLDIGPERKEAWISWVQTYIEELVSSGVPDEERKAAMNSVNPKYVLRNYLCQTAIDAAEQGDYDEVRRLLKVMEHPYDEQPGMEKYARLPPAWAYRPGVCMLSCSS

SEQ ID NO: 230 - DNA, 2109 bp, Physcomitrella patens
atggcatcttcattccgagcagcctcgcactgcatccccgtctctgctcccgcttctgcgtttccaacgaaccccttcttgttgcgttcggcgcccatttggtctggtttcggtggccttagggttggcgttgagaatggtgggagtgaggcggtgcatcgccctccacatgctggatgtggattaggcgtgagggctggagctggtcgagtcgatagaggaggaggccgtgaagttgtgtatggtttgttaggtcgtcgtgcgggtgagagcaggaggggaaaagctggtgcagcgttgctgcgggatttcggttcgtcgcgggggcgtgtcttgactgctgccatgacggataatatgaagaatttgaacctggatgacgacaagtctgtcaatggtgacgtcgccgaaaaggtggataagtctgaagaaatcggagcttcaggcagcttgggaaggaaaaagttggaggacttaatctgggatcattcatttgtgcgagaacttcctggcgataaacgaagtgatggtccaacacgtcaggtgctacacgcatgctactcgaaggtcactccttcagtgcgcgtaaaaaacccggagctggtttcttggtcacggcatgttgctgatctgctggatcttgattataaagaatttgaacgaccagacttccctcttcttttcactggagcttctcaattgaagggcggcttagcttatgcacagtgctacggagggcatcaatttggtgtgtgggctggacagttgggagatggacgtgcaattacgttgggagaaatattgaactcaaaagggcagaggtgggagttgcagttgaaaggagccggtaaaacaccatacagccgtactgctgatgggcttgcagtacttagaagcagcgttcgtgagtacctttgcagtgaagctatgtatcatttgggagttccaacgacacgagctttgtccttagtgactactggagaaggggttttgcgcgacatgttctatgacggcaatgtcaaaatggagccaggtgccgtcgtttgccgtgtatccccgtcattcattcgttttgggtctttccaaattcatgcagcccgggataaggccgacctcccaattgtcaaacaattggctgattatacaattcatcatcattatcctgactttgaggatttgccattcgaaaggcaggggcaagacggttctgaatctcaaaaaggcgagaacaatgctcctcaaattgatacatcgaaaaataaatattcagcatggttcactgagattgcagagcggactgcattgatgattgcaaaatggcaagcagttggattcacacatggagttatgaatactgataatatgagcatattgggtttaactattgactacggtccttttggatttttggacgcttttgatcccaaatatacgccgaatacaacagatcttcctggtcgtcgttatgggtttgccaatcaaccggatattggtctgtggaatgtgatgcagctggcaaacacactatacactgcagaactcattactgcagatgaagcccaatatgtaacaattcaaatatatgctgataaattcatgtttttatatcagcaacacatgagtaacaaaattggtctgaaaacatataacaaagatctgcttagcaagcttctgaacaatatggccttcgacaaagtggactacacaaactttttcaggtcgttcagtaatctgaaagctactccagaaacctcagacgatgacttgattgcaccgctgaaaaatgcactccttgacctgagcaaggaaaggagaaaagtgtggctcgactggttgcaccagtacgtcaagaacgtggttgatgagggtgtatcagaggcagataggaaagccttgatgaattcagtcaacccaagatacgtcctgcgtaattatatgttacagagtgctattgatatggcagaacaaggggacttttcggaagtcgagaacttgctgaaactcatcgagcggccttacgacgatcaacctggaatggagaaatacgctaggcttccgcctgcctgggcttatcgtccaggggtttgcatgttatcttgctcgtcttga

SEQ ID NO: 231 - protein, 702 aa, Physcomitrella patens
MASSFRAASHCIPVSAPASAFPTNPFLLRSAPIWSGFGGLRVGVENGGSEAVHRPPHAGCGLGVRAGAGRVDRGGGREVVYGLLGRRAGESRRGKAGAALLRDFGSSRGRVLTAAMTDNMKNLNLDDDKSVNGDVAEKVDKSEEIGASGSLGRKKLEDLIWDHSFVRELPGDKRSDGPTRQVLHACYSKVTPSVRVKNPELVSWSRHVADLLDLDYKEFERPDFPLLFTGASQLKGGLAYAQCYGGHQFGVWAGQLGDGRAITLGEILNSKGQRWELQLKGAGKTPYSRTADGLAVLRSSVREYLCSEAMYHLGVPTTRALSLVTTGEGVLRDMFYDGNVKMEPGAVVCRVSPSFIRFGSFQIHAARDKADLPIVKQLADYTIHHHYPDFEDLPFERQGQDGSESQKGENNAPQIDTSKNKYSAWFTEIAERTALMIAKWQAVGFTHGVMNTDNMSILGLTIDYGPFGFLDAFDPKYTPNTTDLPGRRYGFANQPDIGLWNVMQLANTLYTAELITADEAQYVTIQIYADKFMFLYQQHMSNKIGLKTYNKDLLSKLLNNMAFDKVDYTNFFRSFSNLKATPETSDDDLIAPLKNALLDLSKERRKVWLDWLHQYVKNVVDEGVSEADRKALMNSVNPRYVLRNYMLQSAIDMAEQGDFSEVENLLKLIERPYDDQPGMEKYARLPPAWAYRPGVCMLSCSS

SEQ ID NO: 232 - DNA, 1941 bp, Populus trichocarpa
atgccaccactgctttctcattcctcctcttcactctccctcctccgtcccttcctccctatcaaattccctttctaccctccccctttcgtcaaatcccaattctgccctctatcacctcctgctcacctcttcaaaccctccctgtcacgccacgtcagcacgagctccttcccttctagcagaggtagaggtagtagtgtttccatggagtcatcctcaccagaaccaactgtgtcactcgactccgtgacgcaggatttaaagaatcaaactttaggtcctgatgatgttagtaaggctaaattgaagcttgaagatctcaattgggaccattcttttgttagagcattgcccggggatccaagggctgatacaattccacgtcaggtgatgcatgcttgctatacgaaagtgttaccatctgctgaagtggagaaccctgagcttgttgcttggtctgattctgttgctgatttatttgatttggatcctaaagaatttgaaaggccagattttccccttttgttttcaggggcttctcctttggttggagcgttgccatatgctcagtgctatggaggacatcaatttgggatgtgggcaggtcagctgggtgatggtagggcaataacacttggggaggttgtaaattcaaagtctgaaaggtgggaactgcaacttaaaggttccgggaggactccgtatagccgttttgcagatggccttgcggttttgcgtagcagcattagggaatttctttgcagtgaagcaatgcactgtctaggaatcccgacaactcgtgcactttctctcgtgacaacaggaaaatatgttacccgtgacatgttttacgatggcaatgcaaaggaagaacctggtgctattgtttgccgagttgcaccatcctttcttcggtttggttcgtaccaaatacatgcctctagagggaaagaggaccttgaaattgttcgtgctttggcagattatgccatcagacatcattttcctcatattgagaacatgaataaaagcgagagcttatcttttagtacaggtgatgaagatcattcagttgtggatctgacctcaaacaagtatgcagcttggacagtggagattgctgaacggactgcttctatgatcgcaagctggcaaggggttggctttacacatggagtaatgaacactgacaacatgagtatactgggtctcaccattgattatggtccctttggattcctggatgcctttgatcctagtttcactccaaacaccacggatcttccaggaagaagatactgttttgcaaatcagcctgatattggtttatggaatattgcacagttcacagctaccctttcaactgccaagttgattagcgataaggaggcagattatgccatggaaagatatggaaacaaattcatggatgagtatcaagctatgatgactagaaaacttggccttccaaagtacaataaacaattgatcagcaaactccttaataatatggctgtggataaagttgattacacaaatttcttccggttgctttccaatgttaaagcagacccaaaaattccggaagatgagttgttagttcccctgaaggctgttcttttagatattggacaggagcgtaaagaggcatggatgagctgggtgcaatcctatgtgcatgagctggctgctagtgggatctcagatgagcagaggaaggcccaaatgaattcagtaaaccccaagtatgttctccgaaactacttgtgccagactgccattgatgcagctgaacaaggtgattacacagaggtcaggaggctccttaaattaatggagcggccgtatgatgagcagcctggaatggaaaaatatgctcgccttccaccagcctgggcgtatcggcctggtgtttgcatgctttcatgctcttcatga

SEQ ID NO: 233 - protein, 646 aa, Populus trichocarpa
MPPLLSHSSSSLSLLRPFLPIKFPFYPPPFVKSQFCPLSPPAHLFKPSLSRHVSTSSFPSSRGRGSSVSMESSSPEPTVSLDSVTQDLKNQTLGPDDVSKAKLKLEDLNWDHSFVRALPGDPRADTIPRQVMHACYTKVLPSAEVENPELVAWSDSVADLFDLDPKEFERPDFPLLFSGASPLVGALPYAQCYGGHQFGMWAGQLGDGRAITLGEVVNSKSERWELQLKGSGRTPYSRFADGLAVLRSSIREFLCSEAMHCLGIPTTRALSLVTTGKYVTRDMFYDGNAKEEPGAIVCRVAPSFLRFGSYQIHASRGKEDLEIVRALADYAIRHHFPHIENMNKSESLSFSTGDEDHSVVDLTSNKYAAWTVEIAERTASMIASWQGVGFTHGVMNTDNMSILGLTIDYGPFGFLDAFDPSFTPNTTDLPGRRYCFANQPDIGLWNIAQFTATLSTAKLISDKEADYAMERYGNKFMDEYQAMMTRKLGLPKYNKQLISKLLNNMAVDKVDYTNFFRLLSNVKADPKIPEDELLVPLKAVLLDIGQERKEAWMSWVQSYVHELAASGISDEQRKAQMNSVNPKYVLRNYLCQTAIDAAEQGDYTEVRRLLKLMERPYDEQPGMEKYARLPPAWAYRPGVCMLSCSS

SEQ ID NO: 234 - DNA, 546 bp, Triticum aestivum
  misc_feature (470)..(470): n is a, c, g, or t
  misc_feature (479)..(479): n is a, c, g, or t
  misc_feature (485)..(485): n is a, c, g, or t
atgcccaagtgttacggtggacaccagtttggttcatgggctggtcagttgggggatggacgagcaataactctcggagaggttctcaattctcgaggtgagaggtgggagttgcagctcaagggtgctggaaagactccttacagccgatttgcagatggcctcgctgtcctgcgcagaagcatccgtgaattcttatgcagtgaagctatgcatggtctaggcattcctacaactcgtgctctttgtctagttgaaactggcaaatctgttgtgcgagatatgttctatgatggtaatgcaaaagaggagccaggtgcaattgtgtgccgtgtagcaccatcgtttttacgttttggttcataccagttacatactacaaggggcaaagaggaccttgaaattgttcgtcgtttggcagactacacaatacgtcatcactacccacatcttgaaaatattaaaaaaantgaagttancttttngaggcagctatgggagacatccaacataatcttacttccaacaatatcgctgggaatttag

SEQ ID NO: 235 - protein, 181 aa, Triticum aestivum
  misc_feature (157)..(157): Xaa can be any naturally occurring amino acid
  misc_feature (160)..(160): Xaa can be any naturally occurring amino acid
  misc_feature (162)..(162): Xaa can be any naturally occurring amino acid
MPKCYGGHQFGSWAGQLGDGRAITLGEVLNSRGERWELQLKGAGKTPYSRFADGLAVLRRSIREFLCSEAMHGLGIPTTRALCLVETGKSVVRDMFYDGNAKEEPGAIVCRVAPSFLRFGSYQLHTTRGKEDLEIVRRLADYTIRHHYPHLENIKKXEVXFXRQLWETSNIILLPTISLGI

SEQ ID NO: 236 - DNA, 1893 bp, Zea mays
atgccgccccagttccccaccgcccgcctcctcctccctagtcacaggctgctcccgctcctctcccctctcccctccgcgtccctgtcccctgctcctcgcaccctccgcctcccgccgccgcagcttcttcaccgagtcgcccgccgccgcccgctgctgcgcggcatggcctccgccgccgcccccgggtcacacgccgccgcggaagcgccccccgtcgacgtggggggagggggcgctggcgccccgcggcggctcgtcctggaggagctaccctgggaccattccttcgtccgcgagctgcctggcgacccgcgatcggacactatcccgcgggaggtcctgcacgcctgttactccagggtgtctccctctgccaaagtggacaaccccaagctggttgcgtggtctgattccgtggccgatctactcgatctggatcacaaagagtttgaaagacctgatttccctcagtttttctcaggagcaactccactagtggggagtttgccctacgcacagtgctatggaggacatcagtttggtgtatgggctggtcagttgggggatggaagagcgatagctcttggagaggttgtcaactctcgaggtgagagatgggagttgcagctcaaaggttgtggaaagactccatacagcagatttgctgatggtcttgctgtcctacgcagcagcatccgtgaattcttatgcagcgaagccatgcacggcctaggcattcctacaactcgtgctctttgtctagttgaaactggaaaatcagttgtccgagatatgttctatgatggcaatgcaaaggaagaacctggtgcaatagtttgtcgtgtagcaccgtcttttttacgttttggttcgtatcagatacacgcttcaaggggcaaagaggacattgagattgttcgtcgtttggcagactacacgatacatcatcactttccacatcttgaaaatatgaaaaagagtgaaggtttgtcattcgagacagctataggagattccccaacaatagatctcacatcaaacaaatatgcagcttgggcagttgaggtggcggagaggactgcttacttgatagctagatggcaaggtgttggcttcacccatggtgtacttaacactgacaacatgagtgtgctgggcctaactattgattatggaccatttggatttctcgatgcatttgatcctagctatactccaaatactactgatcttcctgggaagaggtactgttttgcaaatcaacctgatgttggcttgtggaatattgctcagttcactggaccactgtcctctgctgaacttatcagccaagatgaggcaaattatgtgatggagaggtatgggacaaagttcatggatgagtaccaatctatcatgaccaaaaaactgggcttaactaagtataataagcagctaattagtaagctgcttagcaacatggcagttgacaaggttgactataccaacttcttccgtcttctttcgaatgtcaatgcggatcctggtattccggagaatgagctgcttgtcccactgaaggctgctctcctagatattgggaaagaaaggaaggaagcatggattagttgggtacagacttatattgaagagctggtggagagcggcgttcctgatgaagaaaggaaagccgcgatgaactctgttaatccaaagtatattctccgcaactatctctgccagtctgctatcgacgtagctgagcaaggcgattacgaggaggttcgccgggtgcttagggtaatgcataatccgtatgacgagcagccgggaatggagaaatatgcacggttgccaccagcttgggcatacagacctggagtgtgcatgctgtcctgctcctcgtga

SEQ ID NO: 237 - protein, 630 aa, Zea mays
MPPQFPTARLLLPSHRLLPLLSPLPSASLSPAPRTLRLPPPQLLHRVARRRPLLRGMASAAAPGSHAAAEAPPVDVGGGGAGAPRRLVLEELPWDHSFVRELPGDPRSDTIPREVLHACYSRVSPSAKVDNPKLVAWSDSVADLLDLDHKEFERPDFPQFFSGATPLVGSLPYAQCYGGHQFGVWAGQLGDGRAIALGEVVNSRGERWELQLKGCGKTPYSRFADGLAVLRSSIREFLCSEAMHGLGIPTTRALCLVETGKSVVRDMFYDGNAKEEPGAIVCRVAPSFLRFGSYQIHASRGKEDIEIVRRLADYTIHHHFPHLENMKKSEGLSFETAIGDSPTIDLTSNKYAAWAVEVAERTAYLIARWQGVGFTHGVLNTDNMSVLGLTIDYGPFGFLDAFDPSYTPNTTDLPGKRYCFANQPDVGLWNIAQFTGPLSSAELISQDEANYVMERYGTKFMDEYQSIMTKKLGLTKYNKQLISKLLSNMAVDKVDYTNFFRLLSNVNADPGIPENELLVPLKAALLDIGKERKEAWISWVQTYIEELVESGVPDEERKAAMNSVNPKYILRNYLCQSAIDVAEQGDYEEVRRVLRVMHNPYDEQPGMEKYARLPPAWAYRPGVCMLSCSS

SEQ ID NO: 238 - DNA, 2194 bp, Oryza sativa; identical to SEQ ID NO: 119

SEQ ID NO: 239 - DNA, 56 bp, Artificial sequence
  primer: prm12025
ggggacaagtttgtacaaaaaagcaggcttaaacaatgtacggtggtgatgaagtg

SEQ ID NO: 240 - DNA, 50 bp, Artificial sequence
  primer: prm12026
ggggaccactttgtacaagaaagctgggtcttctgcacagctaccttcac

SEQ ID NO: 241 - DNA, 54 bp, Artificial sequence
  primer: prm18466
ggggacaagtttgtacaaaaaagcaggcttaaacaatgggcaagaaagaacagc

SEQ ID NO: 242 - DNA, 50 bp, Artificial sequence
  primer: prm18467
ggggaccactttgtacaagaaagctgggtcgatgtttaaaaccgttgaga

SEQ ID NO: 243 - DNA, 51 bp, Artificial sequence
  primer: prm18499
ggggacaagtttgtacaaaaaagcaggcttaaacaatgtcggtgtcgtcgc

SEQ ID NO: 244 - DNA, 50 bp, Artificial sequence
  primer: prm18500
ggggaccactttgtacaagaaagctgggtgccttctagaactgaaattcg

SEQ ID NO: 245 - DNA, 56 bp, Artificial sequence
  primer: prm17683
ggggacaagtttgtacaaaaaagcaggcttaaacaatggaggcggcggtgatagac

SEQ ID NO: 246 - DNA, 51 bp, Artificial sequence
  primer: prm17684
ggggaccactttgtacaagaaagctgggtaaacgggtcaaaagcatttccg

SEQ ID NO: 247 - DNA, 56 bp, Artificial sequence
  primer: prm18464
ggggacaagtttgtacaaaaaagcaggcttaaacaatgatatcagcatttggagga

SEQ ID NO: 248 - DNA, 50 bp, Artificial sequence
  primer: prm18465
ggggaccactttgtacaagaaagctgggtctttgcactcgatttcatcat

SEQ ID NO: 249 - DNA, 55 bp, Artificial sequence
  primer: prm17321
ggggacaagtttgtacaaaaaagcaggcttaaacaatggaatcagctgctgtgac

SEQ ID NO: 250 - DNA, 53 bp, Artificial sequence
  primer: prm17322
ggggaccactttgtacaagaaagctgggtagagagaatttatgaggaacatga

The invention claimed is:

1. A method for increasing seed yield and/or biomass in a plant relative to a corresponding control plant, comprising introducing and expressing in a plant a polynucleotide encoding a yield related polypeptide having at least 95% sequence identity to the amino acid sequence of SEQ ID NO: 127.

2. The method of claim 1, wherein the polynucleotide is operably linked to a constitutive promoter, a GOS2 promoter, or a GOS2 promoter from rice.

3. The method of claim 1, wherein the polynucleotide is of plant origin.

4. A plant obtained by the method of claim 1, or a plant cell, plant part, seed, or progeny thereof, wherein said plant, or said plant cell, plant part, seed, or progeny thereof, comprises a recombinant nucleic acid encoding said yield related polypeptide.

5. A construct comprising:
(i) a polynucleotide encoding a yield related polypeptide having at least 95% sequence identity to the amino acid sequence of SEQ ID NO: 127;
(ii) one or more control sequences capable of driving expression of the polynucleotide of (i); and optionally
(iii) a transcription termination sequence.

6. The construct of claim 5, wherein one of said control sequences is a constitutive promoter, a GOS2 promoter, or a GOS2 promoter from rice.

7. A method for making a plant having increased seed yield and/or biomass relative to a corresponding control plant, comprising transforming a plant with the construct of claim 5.

8. A transgenic plant, plant part, or plant cell comprising the construct of claim 5.

9. A method for the production of a transgenic plant having increased seed yield and/or biomass relative to a corresponding control plant, comprising:
(i) introducing and expressing in a plant, plant part, or plant cell a polynucleotide encoding a yield related polypeptide having at least 95% sequence identity to the amino acid sequence of SEQ ID NO: 127; and
(ii) cultivating the plant, plant part, or plant cell under conditions promoting plant growth and development.

10. A transgenic plant having increased seed yield and/or biomass relative to a corresponding control plant, resulting from introducing and expressing the construct of claim 5 in the plant, or a transgenic plant cell derived from said transgenic plant.

11. The transgenic plant of claim 10, or a transgenic plant cell derived thereof, wherein said plant is a crop plant, a monocot, a cereal, beet, rice, maize, wheat, barley, millet, rye, triticale, *sorghum*, emmer, spelt, *secale*, einkorn, teff, milo, or oats.

12. An harvestable part of the plant of claim 11, wherein said harvestable part is shoot biomass and/or seed and comprises a recombinant nucleic acid encoding said polypeptide.

13. A product derived from the plant of claim 11 and/or from an harvestable part of said plant, wherein said product comprises a recombinant nucleic acid encoding said polypeptide.

14. The method of claim 1, wherein said polypeptide comprises at least one CRAL/TRIO N-terminal domain and/or at least one CRAL/TRIO domain.

15. The method of claim 1, wherein the polynucleotide comprises the nucleic acid sequence of SEQ ID NO: 126 or encodes a polypeptide comprising the amino acid sequence of SEQ ID NO: 127.

16. The construct of claim 5, wherein said yield related polypeptide comprises at least one CRAL/TRIO N-terminal domain and/or at least one CRAL/TRIO domain.

17. The construct of claim 5, wherein the polynucleotide comprises the nucleic acid sequence of SEQ ID NO: 126 or encodes a polypeptide comprising the amino acid sequence of SEQ ID NO: 127.

18. The method of claim 9, wherein said yield related polypeptide comprises at least one CRAL/TRIO N-terminal domain and/or at least one CRAL/TRIO domain.

19. The method of claim 9, wherein the polynucleotide comprises the nucleic acid sequence of SEQ ID NO: 126 or encodes a polypeptide comprising the amino acid sequence of SEQ ID NO: 127.

20. The method of claim 9, wherein the polynucleotide is operably linked to a constitutive promoter, a GOS2 promoter, or a GOS2 promoter from rice.

21. The transgenic plant of claim 10, wherein said yield related polypeptide comprises at least one CRAL/TRIO N-terminal domain and/or at least one CRAL/TRIO domain.

22. The transgenic plant of claim 10, wherein the polynucleotide comprises the nucleic acid sequence of SEQ ID NO: 126 or encodes a polypeptide comprising the amino acid sequence of SEQ ID NO: 127.

23. The transgenic plant of claim 10, wherein one of said control sequences is a constitutive promoter, a GOS2 promoter, or a GOS2 promoter from rice.

* * * * *